United States Patent 12,185,725 (BCA CONTROL OF STB) - sequence listing, part 45

SEQ ID NO: 2 - DNA, 61333044 bp, Clonostachys rosea (residues 26,577,656-28,622,090 of 61,333,044)
  misc_feature (902893)..(902893): n is a, c, g, or t
  misc_feature (925033)..(925140): n is a, c, g, or t
  misc_feature (1033130)..(1033130): n is a, c, g, or t
  misc_feature (1119696)..(1119765): n is a, c, g, or t
  misc_feature (1197687)..(1197687): n is a, c, g, or t
  misc_feature (1357701)..(1357701): n is a, c, g, or t
  misc_feature (1380463)..(1380475): n is a, c, g, or t
  misc_feature (1960647)..(1960689): n is a, c, g, or t
  misc_feature (2199349)..(2199349): n is a, c, g, or t
  misc_feature (2326346)..(2326355): n is a, c, g, or t
  misc_feature (2467181)..(2467181): n is a, c, g, or t
  misc_feature (2471470)..(2471494): n is a, c, g, or t
  misc_feature (2545730)..(2545730): n is a, c, g, or t
  misc_feature (2550350)..(2550350): n is a, c, g, or t
  misc_feature (2552104)..(2552104): n is a, c, g, or t
  misc_feature (2625443)..(2625443): n is a, c, g, or t
  misc_feature (2727295)..(2727295): n is a, c, g, or t
  misc_feature (2745424)..(2745491): n is a, c, g, or t
  misc_feature (3066698)..(3066716): n is a, c, g, or t
  misc_feature (3075861)..(3075868): n is a, c, g, or t
  misc_feature (3108941)..(3108941): n is a, c, g, or t
  misc_feature (3127188)..(3127262): n is a, c, g, or t
  misc_feature (3147176)..(3147196): n is a, c, g, or t
  misc_feature (3149962)..(3149986): n is a, c, g, or t
  misc_feature (3150393)..(3150393): n is a, c, g, or t
  misc_feature (3434441)..(3434441): n is a, c, g, or t
  misc_feature (3641650)..(3641651): n is a, c, g, or t
  misc_feature (3829926)..(3830002): n is a, c, g, or t
  misc_feature (3873847)..(3873848): n is a, c, g, or t
  misc_feature (3893991)..(3894012): n is a, c, g, or t
  misc_feature (3896765)..(3896766): n is a, c, g, or t
  misc_feature (4256255)..(4256288): n is a, c, g, or t
  misc_feature (4285750)..(4285750): n is a, c, g, or t
  misc_feature (4380257)..(4380260): n is a, c, g, or t
  misc_feature (4479363)..(4479375): n is a, c, g, or t
  misc_feature (4555810)..(4555812): n is a, c, g, or t
  misc_feature (4681954)..(4682083): n is a, c, g, or t
  misc_feature (4686102)..(4686102): n is a, c, g, or t
  misc_feature (4698561)..(4698561): n is a, c, g, or t
  misc_feature (4732898)..(4732974): n is a, c, g, or t
  misc_feature (4813626)..(4813641): n is a, c, g, or t
  misc_feature (4824561)..(4824592): n is a, c, g, or t
  misc_feature (5169249)..(5169249): n is a, c, g, or t
  misc_feature (5293198)..(5293205): n is a, c, g, or t
  misc_feature (5299170)..(5299177): n is a, c, g, or t
  misc_feature (5319562)..(5319612): n is a, c, g, or t
  misc_feature (5381313)..(5381313): n is a, c, g, or t
  misc_feature (5698596)..(5698605): n is a, c, g, or t
  misc_feature (5793692)..(5793805): n is a, c, g, or t
  misc_feature (5875252)..(5875367): n is a, c, g, or t
  misc_feature (5875730)..(5875843): n is a, c, g, or t
  misc_feature (5877084)..(5877087): n is a, c, g, or t
  misc_feature (6024642)..(6024658): n is a, c, g, or t
  misc_feature (6384000)..(6384009): n is a, c, g, or t
  misc_feature (6526680)..(6526680): n is a, c, g, or t
  misc_feature (6701121)..(6701164): n is a, c, g, or t
  misc_feature (6908518)..(6908549): n is a, c, g, or t
  misc_feature (6924643)..(6924674): n is a, c, g, or t
  misc_feature (7118664)..(7118713): n is a, c, g, or t
  misc_feature (7124557)..(7124601): n is a, c, g, or t
  misc_feature (7125614)..(7125619): n is a, c, g, or t
  misc_feature (7134228)..(7134249): n is a, c, g, or t
  misc_feature (7180941)..(7180971): n is a, c, g, or t
  misc_feature (7369259)..(7369267): n is a, c, g, or t
  misc_feature (7379746)..(7379746): n is a, c, g, or t
  misc_feature (7426682)..(7426720): n is a, c, g, or t
  misc_feature (7695478)..(7695478): n is a, c, g, or t
  misc_feature (7979875)..(7979988): n is a, c, g, or t
  misc_feature (8057150)..(8057150): n is a, c, g, or t
  misc_feature (8081088)..(8081127): n is a, c, g, or t
  misc_feature (8530473)..(8530473): n is a, c, g, or t
  misc_feature (8573797)..(8573797): n is a, c, g, or t
  misc_feature (8796977)..(8797037): n is a, c, g, or t
  misc_feature (8824434)..(8824541): n is a, c, g, or t
  misc_feature (8885371)..(8885371): n is a, c, g, or t
  misc_feature (8911908)..(8911997): n is a, c, g, or t
  misc_feature (8953363)..(8953363): n is a, c, g, or t
  misc_feature (9126215)..(9126235): n is a, c, g, or t
  misc_feature (9227032)..(9227049): n is a, c, g, or t
  misc_feature (9634181)..(9634210): n is a, c, g, or t
  misc_feature (10010030)..(10010046): n is a, c, g, or t
  misc_feature (10128026)..(10128026): n is a, c, g, or t
  misc_feature (10128400)..(10128556): n is a, c, g, or t
  misc_feature (10231514)..(10231547): n is a, c, g, or t
  misc_feature (10419630)..(10419637): n is a, c, g, or t
  misc_feature (10958471)..(10958555): n is a, c, g, or t
  misc_feature (11015205)..(11015205): n is a, c, g, or t
  misc_feature (11049348)..(11049412): n is a, c, g, or t
  misc_feature (11189501)..(11189509): n is a, c, g, or t
  misc_feature (11195465)..(11195546): n is a, c, g, or t
  misc_feature (11214572)..(11214624): n is a, c, g, or t
  misc_feature (11219476)..(11219627): n is a, c, g, or t
  misc_feature (11240257)..(11240257): n is a, c, g, or t
  misc_feature (11388563)..(11388573): n is a, c, g, or t
  misc_feature (11464815)..(11464836): n is a, c, g, or t
  misc_feature (11709990)..(11710079): n is a, c, g, or t
  misc_feature (11712157)..(11712376): n is a, c, g, or t
  misc_feature (11728557)..(11728598): n is a, c, g, or t
  misc_feature (11754639)..(11754639): n is a, c, g, or t
  misc_feature (11783172)..(11783176): n is a, c, g, or t
  misc_feature (11784157)..(11784157): n is a, c, g, or t
  misc_feature (11791852)..(11791865): n is a, c, g, or t
  misc_feature (11908660)..(11908660): n is a, c, g, or t
  misc_feature (11914299)..(11914308): n is a, c, g, or t
  misc_feature (12245368)..(12245374): n is a, c, g, or t
  misc_feature (12257474)..(12257544): n is a, c, g, or t
  misc_feature (12258736)..(12258788): n is a, c, g, or t
  misc_feature (12261631)..(12261707): n is a, c, g, or t
  misc_feature (12291094)..(12291108): n is a, c, g, or t
  misc_feature (12303903)..(12303903): n is a, c, g, or t
  misc_feature (12304438)..(12304438): n is a, c, g, or t
  misc_feature (12550498)..(12550522): n is a, c, g, or t
  misc_feature (12579094)..(12579120): n is a, c, g, or t
  misc_feature (12623493)..(12623493): n is a, c, g, or t
  misc_feature (12739226)..(12739226): n is a, c, g, or t
  misc_feature (12764168)..(12764209): n is a, c, g, or t
  misc_feature (12884427)..(12884443): n is a, c, g, or t
  misc_feature (12976736)..(12976801): n is a, c, g, or t
  misc_feature (12995140)..(12995159): n is a, c, g, or t
  misc_feature (13020970)..(13021014): n is a, c, g, or t
  misc_feature (13178331)..(13178445): n is a, c, g, or t
  misc_feature (13212836)..(13212886): n is a, c, g, or t
  misc_feature (13274894)..(13274930): n is a, c, g, or t
  misc_feature (13312161)..(13312179): n is a, c, g, or t
  misc_feature (13335866)..(13335866): n is a, c, g, or t
  misc_feature (13393492)..(13393510): n is a, c, g, or t
  misc_feature (13406311)..(13406407): n is a, c, g, or t
  misc_feature (13422043)..(13422056): n is a, c, g, or t
  misc_feature (13422715)..(13422715): n is a, c, g, or t
  misc_feature (13613551)..(13613565): n is a, c, g, or t
  misc_feature (14510085)..(14510134): n is a, c, g, or t
  misc_feature (14602431)..(14602453): n is a, c, g, or t
  misc_feature (14728360)..(14728391): n is a, c, g, or t
  misc_feature (14743255)..(14743255): n is a, c, g, or t
  misc_feature (14790730)..(14790855): n is a, c, g, or t
  misc_feature (14844824)..(14844856): n is a, c, g, or t
  misc_feature (14857642)..(14857650): n is a, c, g, or t
  misc_feature (14954553)..(14954586): n is a, c, g, or t
  misc_feature (15057915)..(15057932): n is a, c, g, or t
  misc_feature (15090340)..(15090380): n is a, c, g, or t
  misc_feature (15106865)..(15106880): n is a, c, g, or t
  misc_feature (15172427)..(15172427): n is a, c, g, or t
  misc_feature (15208221)..(15208221): n is a, c, g, or t
  misc_feature (15277190)..(15277194): n is a, c, g, or t
  misc_feature (15287826)..(15287838): n is a, c, g, or t
  misc_feature (15422993)..(15423001): n is a, c, g, or t
  misc_feature (15559220)..(15559220): n is a, c, g, or t
  misc_feature (15707457)..(15707471): n is a, c, g, or t
  misc_feature (15815013)..(15815027): n is a, c, g, or t
  misc_feature (15925019)..(15925095): n is a, c, g, or t
  misc_feature (15947861)..(15947893): n is a, c, g, or t
  misc_feature (15948126)..(15948202): n is a, c, g, or t
  misc_feature (16023402)..(16023405): n is a, c, g, or t
  misc_feature (16302618)..(16302628): n is a, c, g, or t
  misc_feature (16343532)..(16343634): n is a, c, g, or t
  misc_feature (16421571)..(16421571): n is a, c, g, or t
  misc_feature (16829158)..(16829158): n is a, c, g, or t
  misc_feature (16889020)..(16889065): n is a, c, g, or t
  misc_feature (16971473)..(16971473): n is a, c, g, or t
  misc_feature (17004343)..(17004465): n is a, c, g, or t
  misc_feature (17122407)..(17122430): n is a, c, g, or t
  misc_feature (17163647)..(17163649): n is a, c, g, or t
  misc_feature (17462014)..(17462073): n is a, c, g, or t
  misc_feature (17717013)..(17717018): n is a, c, g, or t
  misc_feature (17738404)..(17738445): n is a, c, g, or t
  misc_feature (17778930)..(17778930): n is a, c, g, or t
  misc_feature (17898457)..(17898468): n is a, c, g, or t
  misc_feature (17988176)..(17988219): n is a, c, g, or t
  misc_feature (18136563)..(18136590): n is a, c, g, or t
  misc_feature (18254494)..(18254508): n is a, c, g, or t
  misc_feature (18741719)..(18741742): n is a, c, g, or t
  misc_feature (18795489)..(18795494): n is a, c, g, or t
  misc_feature (18914257)..(18914267): n is a, c, g, or t
  misc_feature (19238183)..(19238183): n is a, c, g, or t
  misc_feature (19312375)..(19312423): n is a, c, g, or t
  misc_feature (19411437)..(19411464): n is a, c, g, or t
  misc_feature (19426354)..(19426412): n is a, c, g, or t
  misc_feature (19542456)..(19542456): n is a, c, g, or t
  misc_feature (19615848)..(19615874): n is a, c, g, or t
  misc_feature (19883978)..(19883996): n is a, c, g, or t
  misc_feature (20196617)..(20196630): n is a, c, g, or t
  misc_feature (20320658)..(20320789): n is a, c, g, or t
  misc_feature (20545591)..(20545634): n is a, c, g, or t
  misc_feature (20739164)..(20739187): n is a, c, g, or t
  misc_feature (20899847)..(20899866): n is a, c, g, or t
  misc_feature (20986808)..(20986813): n is a, c, g, or t
  misc_feature (21231231)..(21231231): n is a, c, g, or t
  misc_feature (21318595)..(21318596): n is a, c, g, or t
  misc_feature (21334019)..(21334019): n is a, c, g, or t
  misc_feature (21334944)..(21335164): n is a, c, g, or t
  misc_feature (21347417)..(21347445): n is a, c, g, or t
  misc_feature (21378695)..(21378702): n is a, c, g, or t
  misc_feature (21381421)..(21381502): n is a, c, g, or t
  misc_feature (21437988)..(21438099): n is a, c, g, or t
  misc_feature (21452746)..(21452805): n is a, c, g, or t
  misc_feature (21481832)..(21481867): n is a, c, g, or t
  misc_feature (21483957)..(21483994): n is a, c, g, or t
  misc_feature (21529742)..(21529773): n is a, c, g, or t
  misc_feature (21596700)..(21596813): n is a, c, g, or t
  misc_feature (21870621)..(21870695): n is a, c, g, or t
  misc_feature (22009481)..(22009483): n is a, c, g, or t
  misc_feature (22023977)..(22023977): n is a, c, g, or t
  misc_feature (22237618)..(22237640): n is a, c, g, or t
  misc_feature (22242574)..(22242605): n is a, c, g, or t
  misc_feature (22483617)..(22483629): n is a, c, g, or t
  misc_feature (22489337)..(22489352): n is a, c, g, or t
  misc_feature (22921861)..(22921888): n is a, c, g, or t
  misc_feature (22924806)..(22924833): n is a, c, g, or t
  misc_feature (23020774)..(23020806): n is a, c, g, or t
  misc_feature (23173942)..(23173948): n is a, c, g, or t
  misc_feature (23364696)..(23364700): n is a, c, g, or t
  misc_feature (23842764)..(23842840): n is a, c, g, or t
  misc_feature (23872665)..(23872759): n is a, c, g, or t
  misc_feature (23924749)..(23924776): n is a, c, g, or t
  misc_feature (23925323)..(23925323): n is a, c, g, or t
  misc_feature (23926202)..(23926218): n is a, c, g, or t
  misc_feature (23999423)..(23999423): n is a, c, g, or t
  misc_feature (24114807)..(24114841): n is a, c, g, or t
  misc_feature (24127499)..(24127621): n is a, c, g, or t
  misc_feature (24172773)..(24172775): n is a, c, g, or t
  misc_feature (24262705)..(24262705): n is a, c, g, or t
  misc_feature (24685982)..(24685987): n is a, c, g, or t
  misc_feature (24799035)..(24799091): n is a, c, g, or t
  misc_feature (24804132)..(24804148): n is a, c, g, or t
  misc_feature (25491920)..(25491920): n is a, c, g, or t
  misc_feature (25845566)..(25845604): n is a, c, g, or t
  misc_feature (26052883)..(26052883): n is a, c, g, or t
  misc_feature (26213448)..(26213448): n is a, c, g, or t
  misc_feature (26588564)..(26588564): n is a, c, g, or t
  misc_feature (26721423)..(26721435): n is a, c, g, or t
  misc_feature (27758440)..(27758444): n is a, c, g, or t
  misc_feature (28024038)..(28024042): n is a, c, g, or t
  misc_feature (28811542)..(28811555): n is a, c, g, or t
  misc_feature (29032888)..(29032888): n is a, c, g, or t
  misc_feature (29052728)..(29052741): n is a, c, g, or t
  misc_feature (29135676)..(29135689): n is a, c, g, or t
  misc_feature (29432603)..(29432608): n is a, c, g, or t
  misc_feature (29567594)..(29567633): n is a, c, g, or t
  misc_feature (29886264)..(29886279): n is a, c, g, or t
  misc_feature (30979938)..(30979943): n is a, c, g, or t
  misc_feature (31156472)..(31156493): n is a, c, g, or t
  misc_feature (31206777)..(31206777): n is a, c, g, or t
  misc_feature (31217735)..(31217761): n is a, c, g, or t
  misc_feature (31235761)..(31235761): n is a, c, g, or t
  misc_feature (31238334)..(31238410): n is a, c, g, or t
  misc_feature (31328119)..(31328119): n is a, c, g, or t
  misc_feature (31526014)..(31526057): n is a, c, g, or t
  misc_feature (31616150)..(31616176): n is a, c, g, or t
  misc_feature (31799122)..(31799142): n is a, c, g, or t
  misc_feature (31982090)..(31982168): n is a, c, g, or t
  misc_feature (32027217)..(32027273): n is a, c, g, or t
  misc_feature (32073229)..(32073288): n is a, c, g, or t
  misc_feature (32243452)..(32243528): n is a, c, g, or t
  misc_feature (32245419)..(32245419): n is a, c, g, or t
  misc_feature (32480835)..(32480967): n is a, c, g, or t
  misc_feature (32509210)..(32509228): n is a, c, g, or t
  misc_feature (32553881)..(32553978): n is a, c, g, or t
  misc_feature (32562686)..(32562687): n is a, c, g, or t
  misc_feature (32568325)..(32568375): n is a, c, g, or t
  misc_feature (32575372)..(32575380): n is a, c, g, or t
  misc_feature (32690297)..(32690297): n is a, c, g, or t
  misc_feature (32733547)..(32733582): n is a, c, g, or t
  misc_feature (32767659)..(32767663): n is a, c, g, or t
  misc_feature (32769577)..(32769581): n is a, c, g, or t
  misc_feature (32795443)..(32795455): n is a, c, g, or t
  misc_feature (32816302)..(32816380): n is a, c, g, or t
  misc_feature (33012005)..(33012007): n is a, c, g, or t
  misc_feature (33301992)..(33301997): n is a, c, g, or t
  misc_feature (33413192)..(33413192): n is a, c, g, or t
  misc_feature (33413443)..(33413492): n is a, c, g, or t
  misc_feature (33414520)..(33414569): n is a, c, g, or t
  misc_feature (33414801)..(33414850): n is a, c, g, or t
  misc_feature (33418872)..(33418872): n is a, c, g, or t
  misc_feature (33419135)..(33419184): n is a, c, g, or t
  misc_feature (33419431)..(33419431): n is a, c, g, or t
  misc_feature (33419898)..(33419947): n is a, c, g, or t
  misc_feature (33420732)..(33420799): n is a, c, g, or t
  misc_feature (33422215)..(33422409): n is a, c, g, or t
  misc_feature (33427895)..(33427975): n is a, c, g, or t
  misc_feature (33428729)..(33428778): n is a, c, g, or t
  misc_feature (33429045)..(33429127): n is a, c, g, or t
  misc_feature (33429378)..(33429378): n is a, c, g, or t
  misc_feature (33429616)..(33429665): n is a, c, g, or t
  misc_feature (33430301)..(33430350): n is a, c, g, or t
  misc_feature (33430651)..(33430701): n is a, c, g, or t
  misc_feature (33431129)..(33431178): n is a, c, g, or t
  misc_feature (33431446)..(33431495): n is a, c, g, or t
  misc_feature (33432373)..(33432373): n is a, c, g, or t
  misc_feature (33432587)..(33432636): n is a, c, g, or t
  misc_feature (33435342)..(33435391): n is a, c, g, or t
  misc_feature (33435680)..(33435729): n is a, c, g, or t
  misc_feature (33435969)..(33435969): n is a, c, g, or t
  misc_feature (33436266)..(33436315): n is a, c, g, or t
  misc_feature (33437552)..(33437601): n is a, c, g, or t
  misc_feature (33438007)..(33438056): n is a, c, g, or t
  misc_feature (33439094)..(33439094): n is a, c, g, or t
  misc_feature (33439313)..(33439362): n is a, c, g, or t
  misc_feature (33439852)..(33439852): n is a, c, g, or t
  misc_feature (33440078)..(33440127): n is a, c, g, or t
  misc_feature (33440374)..(33440374): n is a, c, g, or t
  misc_feature (33440600)..(33440649): n is a, c, g, or t
  misc_feature (33441195)..(33441244): n is a, c, g, or t
  misc_feature (33441475)..(33441524): n is a, c, g, or t
  misc_feature (33446927)..(33446927): n is a, c, g, or t
  misc_feature (33447171)..(33447220): n is a, c, g, or t
  misc_feature (33447823)..(33447909): n is a, c, g, or t
  misc_feature (33448267)..(33448292): n is a, c, g, or t
  misc_feature (33449705)..(33449754): n is a, c, g, or t
  misc_feature (33455621)..(33455670): n is a, c, g, or t
  misc_feature (33455930)..(33456115): n is a, c, g, or t
  misc_feature (33459858)..(33459934): n is a, c, g, or t
  misc_feature (33460293)..(33460342): n is a, c, g, or t
  misc_feature (33460791)..(33460867): n is a, c, g, or t
  misc_feature (33461490)..(33461539): n is a, c, g, or t
  misc_feature (33463213)..(33463262): n is a, c, g, or t
  misc_feature (33464657)..(33464706): n is a, c, g, or t
  misc_feature (33471035)..(33471084): n is a, c, g, or t
  misc_feature (33472004)..(33472053): n is a, c, g, or t
  misc_feature (33486683)..(33486732): n is a, c, g, or t
  misc_feature (33487411)..(33487531): n is a, c, g, or t
  misc_feature (33487814)..(33487863): n is a, c, g, or t
  misc_feature (33488480)..(33488480): n is a, c, g, or t
  misc_feature (33488993)..(33489042): n is a, c, g, or t
  misc_feature (33490286)..(33490335): n is a, c, g, or t
  misc_feature (33490667)..(33490720): n is a, c, g, or t
  misc_feature (33490984)..(33490984): n is a, c, g, or t
  misc_feature (33491199)..(33491248): n is a, c, g, or t
  misc_feature (33491456)..(33491456): n is a, c, g, or t
  misc_feature (33491755)..(33491804): n is a, c, g, or t
  misc_feature (33514692)..(33514741): n is a, c, g, or t
  misc_feature (33515054)..(33515183): n is a, c, g, or t
  misc_feature (33515526)..(33515576): n is a, c, g, or t
  misc_feature (33517398)..(33517569): n is a, c, g, or t
  misc_feature (33517906)..(33517906): n is a, c, g, or t
  misc_feature (33518504)..(33518553): n is a, c, g, or t
  misc_feature (33519259)..(33519259): n is a, c, g, or t
  misc_feature (33519496)..(33519545): n is a, c, g, or t
  misc_feature (33521865)..(33521914): n is a, c, g, or t
  misc_feature (33522263)..(33522368): n is a, c, g, or t
  misc_feature (33524942)..(33524991): n is a, c, g, or t
  misc_feature (33525215)..(33525270): n is a, c, g, or t
  misc_feature (33532546)..(33532658): n is a, c, g, or t
  misc_feature (33532870)..(33532919): n is a, c, g, or t
  misc_feature (33534915)..(33534915): n is a, c, g, or t
  misc_feature (33535190)..(33535239): n is a, c, g, or t
  misc_feature (33535482)..(33535482): n is a, c, g, or t
  misc_feature (33536029)..(33536088): n is a, c, g, or t
  misc_feature (33536265)..(33536265): n is a, c, g, or t
  misc_feature (33536570)..(33536619): n is a, c, g, or t
  misc_feature (33554398)..(33554398): n is a, c, g, or t
  misc_feature (33554611)..(33554660): n is a, c, g, or t
  misc_feature (33554883)..(33554883): n is a, c, g, or t
  misc_feature (33555212)..(33555313): n is a, c, g, or t
  misc_feature (33555610)..(33555610): n is a, c, g, or t
  misc_feature (33555860)..(33555909): n is a, c, g, or t
  misc_feature (33556737)..(33556737): n is a, c, g, or t
  misc_feature (33556963)..(33557012): n is a, c, g, or t
  misc_feature (33560079)..(33560138): n is a, c, g, or t
  misc_feature (33560958)..(33561043): n is a, c, g, or t
  misc_feature (33561472)..(33561521): n is a, c, g, or t
  misc_feature (33564823)..(33564947): n is a, c, g, or t
  misc_feature (33644562)..(33644581): n is a, c, g, or t
  misc_feature (33691725)..(33691812): n is a, c, g, or t
  misc_feature (33715430)..(33715430): n is a, c, g, or t
  misc_feature (33715670)..(33715719): n is a, c, g, or t
  misc_feature (33719192)..(33719192): n is a, c, g, or t
  misc_feature (33719395)..(33719479): n is a, c, g, or t
  misc_feature (33720165)..(33720165): n is a, c, g, or t
  misc_feature (33720502)..(33720551): n is a, c, g, or t
  misc_feature (33721294)..(33721294): n is a, c, g, or t
  misc_feature (33721665)..(33721714): n is a, c, g, or t
  misc_feature (33723644)..(33723644): n is a, c, g, or t
  misc_feature (33723860)..(33723909): n is a, c, g, or t
  misc_feature (33725061)..(33725110): n is a, c, g, or t
  misc_feature (33725557)..(33725606): n is a, c, g, or t
  misc_feature (33736297)..(33736464): n is a, c, g, or t
  misc_feature (33736848)..(33736990): n is a, c, g, or t
  misc_feature (33737538)..(33737587): n is a, c, g, or t
  misc_feature (33745260)..(33745309): n is a, c, g, or t
  misc_feature (33747401)..(33747401): n is a, c, g, or t
  misc_feature (33752031)..(33752080): n is a, c, g, or t
  misc_feature (33757276)..(33757336): n is a, c, g, or t
  misc_feature (33757714)..(33757876): n is a, c, g, or t
  misc_feature (33760547)..(33760547): n is a, c, g, or t
  misc_feature (33760971)..(33761020): n is a, c, g, or t
  misc_feature (33761266)..(33761315): n is a, c, g, or t
  misc_feature (33761649)..(33761726): n is a, c, g, or t
  misc_feature (33761956)..(33761956): n is a, c, g, or t
  misc_feature (33762211)..(33762260): n is a, c, g, or t
  misc_feature (33762651)..(33762651): n is a, c, g, or t
  misc_feature (33762856)..(33762921): n is a, c, g, or t
  misc_feature (33764334)..(33764522): n is a, c, g, or t
  misc_feature (33764749)..(33764798): n is a, c, g, or t
  misc_feature (33765656)..(33765726): n is a, c, g, or t
  misc_feature (33766347)..(33766535): n is a, c, g, or t
  misc_feature (33777512)..(33777512): n is a, c, g, or t
  misc_feature (33777738)..(33777787): n is a, c, g, or t
  misc_feature (33780182)..(33780182): n is a, c, g, or t
  misc_feature (33780566)..(33780720): n is a, c, g, or t
  misc_feature (33781075)..(33781075): n is a, c, g, or t
  misc_feature (33781329)..(33781378): n is a, c, g, or t
  misc_feature (33782583)..(33782632): n is a, c, g, or t
  misc_feature (33783896)..(33784025): n is a, c, g, or t
  misc_feature (33787726)..(33787726): n is a, c, g, or t
  misc_feature (33787949)..(33787998): n is a, c, g, or t
  misc_feature (33788771)..(33788771): n is a, c, g, or t
  misc_feature (33789459)..(33789508): n is a, c, g, or t
  misc_feature (33789972)..(33790021): n is a, c, g, or t
  misc_feature (33857662)..(33857662): n is a, c, g, or t
  misc_feature (33857939)..(33857988): n is a, c, g, or t
  misc_feature (33861387)..(33861387): n is a, c, g, or t
  misc_feature (33862104)..(33862153): n is a, c, g, or t
  misc_feature (33865020)..(33865069): n is a, c, g, or t
  misc_feature (33870908)..(33870908): n is a, c, g, or t
  misc_feature (33871198)..(33871274): n is a, c, g, or t
  misc_feature (33872065)..(33872065): n is a, c, g, or t
  misc_feature (33872474)..(33872474): n is a, c, g, or t
  misc_feature (33872686)..(33872735): n is a, c, g, or t
  misc_feature (33874869)..(33875091): n is a, c, g, or t
  misc_feature (33877000)..(33877000): n is a, c, g, or t
  misc_feature (33877350)..(33877399): n is a, c, g, or t
  misc_feature (33878105)..(33878105): n is a, c, g, or t
  misc_feature (33878317)..(33878366): n is a, c, g, or t
  misc_feature (33879634)..(33879683): n is a, c, g, or t
  misc_feature (33879952)..(33880010): n is a, c, g, or t
  misc_feature (33882076)..(33882125): n is a, c, g, or t
  misc_feature (33890926)..(33890926): n is a, c, g, or t
  misc_feature (33892306)..(33892355): n is a, c, g, or t
  misc_feature (33896350)..(33896350): n is a, c, g, or t
  misc_feature (33896581)..(33896701): n is a, c, g, or t
  misc_feature (33896914)..(33896944): n is a, c, g, or t
  misc_feature (33904428)..(33904428): n is a, c, g, or t
  misc_feature (33904671)..(33904720): n is a, c, g, or t
  misc_feature (33905807)..(33905807): n is a, c, g, or t
  misc_feature (33906622)..(33906710): n is a, c, g, or t
  misc_feature (33910052)..(33910101): n is a, c, g, or t
  misc_feature (33958460)..(33958475): n is a, c, g, or t
  misc_feature (33963167)..(33963174): n is a, c, g, or t
  misc_feature (34281657)..(34281706): n is a, c, g, or t
  misc_feature (34889456)..(34889456): n is a, c, g, or t
  misc_feature (35028292)..(35028305): n is a, c, g, or t
  misc_feature (35028465)..(35028514): n is a, c, g, or t
  misc_feature (35030595)..(35030644): n is a, c, g, or t
  misc_feature (35033032)..(35033081): n is a, c, g, or t
  misc_feature (35033691)..(35033809): n is a, c, g, or t
  misc_feature (35034260)..(35034275): n is a, c, g, or t
  misc_feature (35034445)..(35034494): n is a, c, g, or t
  misc_feature (35034989)..(35035113): n is a, c, g, or t
  misc_feature (35035292)..(35035366): n is a, c, g, or t
  misc_feature (35035764)..(35035813): n is a, c, g, or t
  misc_feature (35036625)..(35036625): n is a, c, g, or t
  misc_feature (35036852)..(35036901): n is a, c, g, or t
  misc_feature (35037155)..(35037155): n is a, c, g, or t
  misc_feature (35037410)..(35037459): n is a, c, g, or t
  misc_feature (35079218)..(35079218): n is a, c, g, or t
  misc_feature (35079441)..(35079490): n is a, c, g, or t
  misc_feature (35080005)..(35080005): n is a, c, g, or t
  misc_feature (35080310)..(35080359): n is a, c, g, or t
  misc_feature (35081102)..(35081102): n is a, c, g, or t
  misc_feature (35081399)..(35081448): n is a, c, g, or t
  misc_feature (35082115)..(35082164): n is a, c, g, or t
  misc_feature (35082387)..(35082441): n is a, c, g, or t
  misc_feature (35082804)..(35082855): n is a, c, g, or t
  misc_feature (35083197)..(35083278): n is a, c, g, or t
  misc_feature (35083507)..(35083556): n is a, c, g, or t
  misc_feature (35083962)..(35083962): n is a, c, g, or t
  misc_feature (35084385)..(35084434): n is a, c, g, or t
  misc_feature (35085756)..(35085805): n is a, c, g, or t
  misc_feature (35091454)..(35091454): n is a, c, g, or t
  misc_feature (35091817)..(35091866): n is a, c, g, or t
  misc_feature (35092362)..(35092411): n is a, c, g, or t
  misc_feature (35093242)..(35093291): n is a, c, g, or t
  misc_feature (35094374)..(35094423): n is a, c, g, or t
  misc_feature (35094676)..(35094733): n is a, c, g, or t
  misc_feature (35095906)..(35095906): n is a, c, g, or t
  misc_feature (35096214)..(35096263): n is a, c, g, or t
  misc_feature (35096502)..(35096502): n is a, c, g, or t
  misc_feature (35096781)..(35096830): n is a, c, g, or t
  misc_feature (35097801)..(35097801): n is a, c, g, or t
  misc_feature (35098003)..(35098052): n is a, c, g, or t
  misc_feature (35100368)..(35100368): n is a, c, g, or t
  misc_feature (35100700)..(35100749): n is a, c, g, or t
  misc_feature (35109146)..(35109195): n is a, c, g, or t
  misc_feature (35110378)..(35110427): n is a, c, g, or t
  misc_feature (35111169)..(35111251): n is a, c, g, or t
  misc_feature (35111587)..(35111636): n is a, c, g, or t
  misc_feature (35113923)..(35113923): n is a, c, g, or t
  misc_feature (35114183)..(35114232): n is a, c, g, or t
  misc_feature (35115735)..(35115735): n is a, c, g, or t
  misc_feature (35116000)..(35116049): n is a, c, g, or t
  misc_feature (35116646)..(35116646): n is a, c, g, or t
  misc_feature (35116957)..(35117006): n is a, c, g, or t
  misc_feature (35121608)..(35121608): n is a, c, g, or t
  misc_feature (35121862)..(35121911): n is a, c, g, or t
  misc_feature (35122146)..(35122146): n is a, c, g, or t
  misc_feature (35122386)..(35122435): n is a, c, g, or t
  misc_feature (35130290)..(35130290): n is a, c, g, or t
  misc_feature (35130497)..(35130546): n is a, c, g, or t
  misc_feature (35131101)..(35131101): n is a, c, g, or t
  misc_feature (35131595)..(35131644): n is a, c, g, or t
  misc_feature (35134125)..(35134125): n is a, c, g, or t
  misc_feature (35134392)..(35134441): n is a, c, g, or t
  misc_feature (35136018)..(35136141): n is a, c, g, or t
  misc_feature (35136388)..(35136437): n is a, c, g, or t
  misc_feature (35136953)..(35137002): n is a, c, g, or t
  misc_feature (35137222)..(35137271): n is a, c, g, or t
  misc_feature (35137636)..(35137685): n is a, c, g, or t
  misc_feature (35138029)..(35138029): n is a, c, g, or t
  misc_feature (35138273)..(35138372): n is a, c, g, or t
  misc_feature (35142926)..(35142926): n is a, c, g, or t
  misc_feature (35143647)..(35143696): n is a, c, g, or t
  misc_feature (35144462)..(35144511): n is a, c, g, or t
  misc_feature (35152919)..(35152968): n is a, c, g, or t
  misc_feature (35161641)..(35161641): n is a, c, g, or t
  misc_feature (35161842)..(35161915): n is a, c, g, or t
  misc_feature (35180600)..(35180600): n is a, c, g, or t
  misc_feature (35180937)..(35180986): n is a, c, g, or t
  misc_feature (35198548)..(35198694): n is a, c, g, or t
  misc_feature (35203680)..(35203680): n is a, c, g, or t
  misc_feature (35203935)..(35203984): n is a, c, g, or t
  misc_feature (35206047)..(35206096): n is a, c, g, or t
  misc_feature (35208507)..(35208601): n is a, c, g, or t
  misc_feature (35214269)..(35214269): n is a, c, g, or t
  misc_feature (35214510)..(35214559): n is a, c, g, or t
  misc_feature (35225308)..(35225360): n is a, c, g, or t
  misc_feature (35225809)..(35225968): n is a, c, g, or t
  misc_feature (35227401)..(35227587): n is a, c, g, or t
  misc_feature (35230067)..(35230247): n is a, c, g, or t
  misc_feature (35231225)..(35231300): n is a, c, g, or t
  misc_feature (35233217)..(35233343): n is a, c, g, or t
  misc_feature (35233562)..(35233727): n is a, c, g, or t
  misc_feature (35234521)..(35234691): n is a, c, g, or t
  misc_feature (35235061)..(35235110): n is a, c, g, or t
  misc_feature (35236458)..(35236533): n is a, c, g, or t
  misc_feature (35237141)..(35237305): n is a, c, g, or t
  misc_feature (35238248)..(35238251): n is a, c, g, or t
  misc_feature (35239631)..(35239738): n is a, c, g, or t
  misc_feature (35243337)..(35243434): n is a, c, g, or t
  misc_feature (35243650)..(35243699): n is a, c, g, or t
  misc_feature (35244082)..(35244131): n is a, c, g, or t
  misc_feature (35247433)..(35247629): n is a, c, g, or t
  misc_feature (35278784)..(35278784): n is a, c, g, or t
  misc_feature (35927600)..(35927602): n is a, c, g, or t
  misc_feature (36076112)..(36076118): n is a, c, g, or t
  misc_feature (36558952)..(36558952): n is a, c, g, or t
  misc_feature (36721326)..(36721354): n is a, c, g, or t
  misc_feature (36751236)..(36751284): n is a, c, g, or t
  misc_feature (36751493)..(36751542): n is a, c, g, or t
  misc_feature (36752145)..(36752194): n is a, c, g, or t
  misc_feature (36754485)..(36754485): n is a, c, g, or t
  misc_feature (36756267)..(36756321): n is a, c, g, or t
  misc_feature (36760467)..(36760516): n is a, c, g, or t
  misc_feature (36760766)..(36760835): n is a, c, g, or t
  misc_feature (36781768)..(36781768): n is a, c, g, or t
  misc_feature (36786774)..(36786823): n is a, c, g, or t
  misc_feature (36787771)..(36787828): n is a, c, g, or t
  misc_feature (36793867)..(36793982): n is a, c, g, or t
  misc_feature (36854057)..(36854090): n is a, c, g, or t
  misc_feature (36859705)..(36859754): n is a, c, g, or t
  misc_feature (36880443)..(36880574): n is a, c, g, or t
  misc_feature (37089224)..(37089234): n is a, c, g, or t
  misc_feature (37175105)..(37175105): n is a, c, g, or t
  misc_feature (37177932)..(37177981): n is a, c, g, or t
  misc_feature (37178717)..(37178717): n is a, c, g, or t
  misc_feature (37182147)..(37182196): n is a, c, g, or t
  misc_feature (37338837)..(37338839): n is a, c, g, or t
  misc_feature (37387557)..(37387580): n is a, c, g, or t
  misc_feature (37404405)..(37404405): n is a, c, g, or t
  misc_feature (37896492)..(37896492): n is a, c, g, or t
  misc_feature (38029788)..(38029805): n is a, c, g, or t
  misc_feature (38253678)..(38253682): n is a, c, g, or t
  misc_feature (38372269)..(38372269): n is a, c, g, or t
  misc_feature (38657055)..(38657068): n is a, c, g, or t
  misc_feature (38744786)..(38744804): n is a, c, g, or t
  misc_feature (38760806)..(38760807): n is a, c, g, or t
  misc_feature (39127368)..(39127370): n is a, c, g, or t
  misc_feature (39365321)..(39365321): n is a, c, g, or t
  misc_feature (39366370)..(39366419): n is a, c, g, or t
  misc_feature (39798534)..(39798540): n is a, c, g, or t
  misc_feature (39933698)..(39933698): n is a, c, g, or t
  misc_feature (40160832)..(40160841): n is a, c, g, or t
  misc_feature (40219027)..(40219027): n is a, c, g, or t
  misc_feature (40475897)..(40475916): n is a, c, g, or t
  misc_feature (40536802)..(40536875): n is a, c, g, or t
  misc_feature (40541247)..(40541247): n is a, c, g, or t
  misc_feature (40542909)..(40542958): n is a, c, g, or t
  misc_feature (40601853)..(40601853): n is a, c, g, or t
  misc_feature (40613650)..(40613697): n is a, c, g, or t
  misc_feature (40613837)..(40613921): n is a, c, g, or t
  misc_feature (40621294)..(40621298): n is a, c, g, or t
  misc_feature (40629840)..(40629889): n is a, c, g, or t
  misc_feature (40654710)..(40654766): n is a, c, g, or t
  misc_feature (40654950)..(40655107): n is a, c, g, or t
  misc_feature (40655649)..(40655698): n is a, c, g, or t
  misc_feature (40677217)..(40677266): n is a, c, g, or t
  misc_feature (40682908)..(40682957): n is a, c, g, or t
  misc_feature (40686565)..(40686680): n is a, c, g, or t
  misc_feature (40687746)..(40687746): n is a, c, g, or t
  misc_feature (40690876)..(40690925): n is a, c, g, or t
  misc_feature (40702525)..(40702525): n is a, c, g, or t
  misc_feature (40704362)..(40704433): n is a, c, g, or t
  misc_feature (40705952)..(40705952): n is a, c, g, or t
  misc_feature (41005510)..(41005523): n is a, c, g, or t
  misc_feature (41270147)..(41270147): n is a, c, g, or t
  misc_feature (41746320)..(41746369): n is a, c, g, or t
  misc_feature (41871580)..(41871580): n is a, c, g, or t
  misc_feature (41905050)..(41905238): n is a, c, g, or t
  misc_feature (41905385)..(41905434): n is a, c, g, or t
  misc_feature (42002799)..(42002808): n is a, c, g, or t
  misc_feature (42038317)..(42038317): n is a, c, g, or t
  misc_feature (42046619)..(42046619): n is a, c, g, or t
  misc_feature (42124558)..(42124558): n is a, c, g, or t
  misc_feature (42125551)..(42125559): n is a, c, g, or t
  misc_feature (42125825)..(42125916): n is a, c, g, or t
  misc_feature (42130130)..(42130162): n is a, c, g, or t
  misc_feature (42131478)..(42131527): n is a, c, g, or t
  misc_feature (42135500)..(42135598): n is a, c, g, or t
  misc_feature (42136258)..(42136359): n is a, c, g, or t
  misc_feature (42157774)..(42157823): n is a, c, g, or t
  misc_feature (42159594)..(42159614): n is a, c, g, or t
  misc_feature (42161235)..(42161284): n is a, c, g, or t
  misc_feature (42161570)..(42161628): n is a, c, g, or t
  misc_feature (42161724)..(42161773): n is a, c, g, or t
  misc_feature (42163071)..(42163071): n is a, c, g, or t
  misc_feature (42163381)..(42163533): n is a, c, g, or t
  misc_feature (42163682)..(42163731): n is a, c, g, or t
  misc_feature (42163829)..(42163919): n is a, c, g, or t
  misc_feature (42165005)..(42165069): n is a, c, g, or t
  misc_feature (42196215)..(42196215): n is a, c, g, or t
  misc_feature (42197832)..(42197832): n is a, c, g, or t
  misc_feature (42365140)..(42365154): n is a, c, g, or t
  misc_feature (42495309)..(42495358): n is a, c, g, or t
  misc_feature (42650974)..(42650974): n is a, c, g, or t
  misc_feature (42746276)..(42746313): n is a, c, g, or t
  misc_feature (42806787)..(42806836): n is a, c, g, or t
  misc_feature (43219408)..(43219457): n is a, c, g, or t
  misc_feature (43221379)..(43221428): n is a, c, g, or t
  misc_feature (43221620)..(43221658): n is a, c, g, or t
  misc_feature (43534396)..(43534396): n is a, c, g, or t
  misc_feature (43534707)..(43534756): n is a, c, g, or t
  misc_feature (43535085)..(43535134): n is a, c, g, or t
  misc_feature (43535823)..(43535872): n is a, c, g, or t
  misc_feature (43546955)..(43546955): n is a, c, g, or t
  misc_feature (43548403)..(43548483): n is a, c, g, or t
  misc_feature (43577755)..(43577804): n is a, c, g, or t
  misc_feature (43578864)..(43578913): n is a, c, g, or t
  misc_feature (43582060)..(43582180): n is a, c, g, or t
  misc_feature (43582407)..(43582526): n is a, c, g, or t
  misc_feature (43587257)..(43587306): n is a, c, g, or t
  misc_feature (43599573)..(43599573): n is a, c, g, or t
  misc_feature (43601863)..(43601912): n is a, c, g, or t
  misc_feature (43602685)..(43602685): n is a, c, g, or t
  misc_feature (43604092)..(43604141): n is a, c, g, or t
  misc_feature (43605005)..(43605101): n is a, c, g, or t
  misc_feature (43606471)..(43606559): n is a, c, g, or t
  misc_feature (43607097)..(43607146): n is a, c, g, or t
  misc_feature (43608650)..(43608650): n is a, c, g, or t
  misc_feature (43630386)..(43630435): n is a, c, g, or t
  misc_feature (43631414)..(43631464): n is a, c, g, or t
  misc_feature (43631624)..(43631624): n is a, c, g, or t
  misc_feature (43632816)..(43632865): n is a, c, g, or t
  misc_feature (43636128)..(43636128): n is a, c, g, or t
  misc_feature (43853537)..(43853586): n is a, c, g, or t
  misc_feature (43856075)..(43856104): n is a, c, g, or t
  misc_feature (43950669)..(43950787): n is a, c, g, or t
  misc_feature (43951175)..(43951175): n is a, c, g, or t
  misc_feature (43951355)..(43951355): n is a, c, g, or t
  misc_feature (44020272)..(44020321): n is a, c, g, or t
  misc_feature (44038026)..(44038075): n is a, c, g, or t
  misc_feature (44039269)..(44039318): n is a, c, g, or t
  misc_feature (44039507)..(44039519): n is a, c, g, or t
  misc_feature (44039913)..(44039972): n is a, c, g, or t
  misc_feature (44042323)..(44042323): n is a, c, g, or t
  misc_feature (44043216)..(44043262): n is a, c, g, or t
  misc_feature (44044382)..(44044382): n is a, c, g, or t
  misc_feature (44045359)..(44045408): n is a, c, g, or t
  misc_feature (44046493)..(44046542): n is a, c, g, or t
  misc_feature (44048248)..(44048297): n is a, c, g, or t
  misc_feature (44049307)..(44049307): n is a, c, g, or t
  misc_feature (44050623)..(44050672): n is a, c, g, or t
  misc_feature (44052195)..(44052273): n is a, c, g, or t
  misc_feature (44053591)..(44053591): n is a, c, g, or t
  misc_feature (44054685)..(44054734): n is a, c, g, or t
  misc_feature (44055113)..(44055113): n is a, c, g, or t
  misc_feature (44057238)..(44057287): n is a, c, g, or t
  misc_feature (44070451)..(44070500): n is a, c, g, or t
  misc_feature (44072445)..(44072445): n is a, c, g, or t
  misc_feature (44306782)..(44306782): n is a, c, g, or t
  misc_feature (44336506)..(44336555): n is a, c, g, or t
  misc_feature (44349681)..(44349730): n is a, c, g, or t
  misc_feature (44355418)..(44355418): n is a, c, g, or t
  misc_feature (44356479)..(44356528): n is a, c, g, or t
  misc_feature (44357770)..(44357770): n is a, c, g, or t
  misc_feature (44359025)..(44359074): n is a, c, g, or t
  misc_feature (44369007)..(44369056): n is a, c, g, or t
  misc_feature (44369949)..(44369998): n is a, c, g, or t
  misc_feature (44372144)..(44372165): n is a, c, g, or t
  misc_feature (44372679)..(44372728): n is a, c, g, or t
  misc_feature (44375518)..(44375567): n is a, c, g, or t
  misc_feature (44389231)..(44389306): n is a, c, g, or t
  misc_feature (44407026)..(44407026): n is a, c, g, or t
  misc_feature (44408059)..(44408108): n is a, c, g, or t
  misc_feature (44408623)..(44408623): n is a, c, g, or t
  misc_feature (44411379)..(44411428): n is a, c, g, or t
  misc_feature (44423256)..(44423256): n is a, c, g, or t
  misc_feature (44427336)..(44427417): n is a, c, g, or t
  misc_feature (44427654)..(44427732): n is a, c, g, or t
  misc_feature (44443749)..(44443754): n is a, c, g, or t
  misc_feature (44443906)..(44443906): n is a, c, g, or t
  misc_feature (44446067)..(44446116): n is a, c, g, or t
  misc_feature (44448290)..(44448339): n is a, c, g, or t
  misc_feature (44449923)..(44449972): n is a, c, g, or t
  misc_feature (44450217)..(44450266): n is a, c, g, or t
  misc_feature (44452043)..(44452043): n is a, c, g, or t
  misc_feature (44453896)..(44453945): n is a, c, g, or t
  misc_feature (44700759)..(44700765): n is a, c, g, or t
  misc_feature (44895155)..(44895155): n is a, c, g, or t
  misc_feature (44895296)..(44895300): n is a, c, g, or t
  misc_feature (44896928)..(44896977): n is a, c, g, or t
  misc_feature (44901141)..(44901176): n is a, c, g, or t
  misc_feature (44901298)..(44901298): n is a, c, g, or t
  misc_feature (44903505)..(44903554): n is a, c, g, or t
  misc_feature (44906645)..(44906645): n is a, c, g, or t
  misc_feature (44907661)..(44907710): n is a, c, g, or t
  misc_feature (44913696)..(44913836): n is a, c, g, or t
  misc_feature (44913943)..(44913943): n is a, c, g, or t
  misc_feature (44933426)..(44933426): n is a, c, g, or t
  misc_feature (45194241)..(45194241): n is a, c, g, or t
  misc_feature (45194386)..(45194435): n is a, c, g, or t
  misc_feature (45326877)..(45326883): n is a, c, g, or t
  misc_feature (45486608)..(45486657): n is a, c, g, or t
  misc_feature (45489284)..(45489376): n is a, c, g, or t
  misc_feature (45491467)..(45491520): n is a, c, g, or t
  misc_feature (45495894)..(45495962): n is a, c, g, or t
  misc_feature (45496093)..(45496093): n is a, c, g, or t
  misc_feature (45496650)..(45496699): n is a, c, g, or t
  misc_feature (45501859)..(45501859): n is a, c, g, or t
  misc_feature (45506176)..(45506225): n is a, c, g, or t
  misc_feature (45524833)..(45524833): n is a, c, g, or t
  misc_feature (45578968)..(45578968): n is a, c, g, or t
  misc_feature (45606351)..(45606379): n is a, c, g, or t
  misc_feature (45692443)..(45692492): n is a, c, g, or t
  misc_feature (45705468)..(45705468): n is a, c, g, or t
  misc_feature (46044914)..(46044922): n is a, c, g, or t
  misc_feature (46351876)..(46351900): n is a, c, g, or t
  misc_feature (46478098)..(46478114): n is a, c, g, or t
  misc_feature (46720480)..(46720529): n is a, c, g, or t
  misc_feature (46720759)..(46720808): n is a, c, g, or t
  misc_feature (46721677)..(46721726): n is a, c, g, or t
  misc_feature (46723540)..(46723589): n is a, c, g, or t
  misc_feature (46726295)..(46726302): n is a, c, g, or t
  misc_feature (46726587)..(46726702): n is a, c, g, or t
  misc_feature (46726870)..(46726872): n is a, c, g, or t
  misc_feature (46734480)..(46734529): n is a, c, g, or t
  misc_feature (46746823)..(46746872): n is a, c, g, or t
  misc_feature (46748377)..(46748377): n is a, c, g, or t
  misc_feature (46751310)..(46751310): n is a, c, g, or t
  misc_feature (46757069)..(46757118): n is a, c, g, or t
  misc_feature (46773462)..(46773462): n is a, c, g, or t
  misc_feature (46774633)..(46774682): n is a, c, g, or t
  misc_feature (46805496)..(46805496): n is a, c, g, or t
  misc_feature (46856816)..(46856816): n is a, c, g, or t
  misc_feature (46915431)..(46915482): n is a, c, g, or t
  misc_feature (46945588)..(46945698): n is a, c, g, or t
  misc_feature (46946498)..(46946547): n is a, c, g, or t
  misc_feature (46947321)..(46947391): n is a, c, g, or t
  misc_feature (46954229)..(46954229): n is a, c, g, or t
  misc_feature (46991546)..(46991595): n is a, c, g, or t
  misc_feature (47012439)..(47012488): n is a, c, g, or t
  misc_feature (47013181)..(47013255): n is a, c, g, or t
  misc_feature (47013461)..(47013461): n is a, c, g, or t
  misc_feature (47013687)..(47013687): n is a, c, g, or t
  misc_feature (47014874)..(47014923): n is a, c, g, or t
  misc_feature (47018690)..(47018739): n is a, c, g, or t
  misc_feature (47021289)..(47021338): n is a, c, g, or t
  misc_feature (47023128)..(47023177): n is a, c, g, or t
  misc_feature (47431704)..(47431725): n is a, c, g, or t
  misc_feature (47582581)..(47582630): n is a, c, g, or t
  misc_feature (47603787)..(47603793): n is a, c, g, or t
  misc_feature (47800801)..(47800850): n is a, c, g, or t
  misc_feature (47822004)..(47822071): n is a, c, g, or t
  misc_feature (47822302)..(47822302): n is a, c, g, or t
  misc_feature (47823428)..(47823440): n is a, c, g, or t
  misc_feature (47823623)..(47823672): n is a, c, g, or t
  misc_feature (47826286)..(47826286): n is a, c, g, or t
  misc_feature (47833218)..(47833231): n is a, c, g, or t
  misc_feature (47867002)..(47867006): n is a, c, g, or t
  misc_feature (48028309)..(48028358): n is a, c, g, or t
  misc_feature (48052295)..(48052326): n is a, c, g, or t
  misc_feature (48090187)..(48090236): n is a, c, g, or t
  misc_feature (48090502)..(48090502): n is a, c, g, or t
  misc_feature (48092301)..(48092301): n is a, c, g, or t
  misc_feature (48093530)..(48093579): n is a, c, g, or t
  misc_feature (48094912)..(48094919): n is a, c, g, or t
  misc_feature (48102802)..(48102802): n is a, c, g, or t
  misc_feature (48103004)..(48103053): n is a, c, g, or t
  misc_feature (48125722)..(48125825): n is a, c, g, or t
  misc_feature (48130916)..(48130916): n is a, c, g, or t
  misc_feature (48641833)..(48641882): n is a, c, g, or t
  misc_feature (48765772)..(48765772): n is a, c, g, or t
  misc_feature (48789940)..(48789989): n is a, c, g, or t
  misc_feature (48801186)..(48801191): n is a, c, g, or t
  misc_feature (48907078)..(48907108): n is a, c, g, or t
  misc_feature (49004786)..(49004786): n is a, c, g, or t
  misc_feature (49075192)..(49075192): n is a, c, g, or t
  misc_feature (49075714)..(49075732): n is a, c, g, or t
  misc_feature (49468758)..(49468807): n is a, c, g, or t
  misc_feature (49933382)..(49933382): n is a, c, g, or t
  misc_feature (49934001)..(49934050): n is a, c, g, or t
  misc_feature (49943873)..(49943922): n is a, c, g, or t
  misc_feature (49944180)..(49944215): n is a, c, g, or t
  misc_feature (49944311)..(49944360): n is a, c, g, or t
  misc_feature (49944503)..(49944550): n is a, c, g, or t
  misc_feature (49944941)..(49944990): n is a, c, g, or t
  misc_feature (50058977)..(50058990): n is a, c, g, or t
  misc_feature (50406318)..(50406318): n is a, c, g, or t
  misc_feature (50409573)..(50409622): n is a, c, g, or t
  misc_feature (50410435)..(50410501): n is a, c, g, or t
  misc_feature (50410750)..(50410879): n is a, c, g, or t
  misc_feature (51054325)..(51054353): n is a, c, g, or t
  misc_feature (51058159)..(51058246): n is a, c, g, or t
  misc_feature (51058500)..(51058549): n is a, c, g, or t
  misc_feature (51268331)..(51268331): n is a, c, g, or t
  misc_feature (51269087)..(51269087): n is a, c, g, or t
  misc_feature (51270670)..(51270719): n is a, c, g, or t
  misc_feature (51306378)..(51306456): n is a, c, g, or t
  misc_feature (51309618)..(51309618): n is a, c, g, or t
  misc_feature (51311662)..(51311711): n is a, c, g, or t
  misc_feature (51525717)..(51525717): n is a, c, g, or t
  misc_feature (51528304)..(51528391): n is a, c, g, or t
  misc_feature (51528551)..(51528652): n is a, c, g, or t
  misc_feature (51596811)..(51596811): n is a, c, g, or t
  misc_feature (51597115)..(51597120): n is a, c, g, or t
  misc_feature (51597971)..(51598033): n is a, c, g, or t
  misc_feature (51598725)..(51598725): n is a, c, g, or t
  misc_feature (51602084)..(51602133): n is a, c, g, or t
  misc_feature (51603048)..(51603048): n is a, c, g, or t
  misc_feature (51784931)..(51784980): n is a, c, g, or t
  misc_feature (51842434)..(51842483): n is a, c, g, or t
  misc_feature (51842699)..(51842748): n is a, c, g, or t
  misc_feature (51850328)..(51850328): n is a, c, g, or t
  misc_feature (51853824)..(51853952): n is a, c, g, or t
  misc_feature (51860271)..(51860271): n is a, c, g, or t
  misc_feature (51861427)..(51861476): n is a, c, g, or t
  misc_feature (51993241)..(51993241): n is a, c, g, or t
  misc_feature (51997134)..(51997183): n is a, c, g, or t
  misc_feature (52006530)..(52006530): n is a, c, g, or t
  misc_feature (52007265)..(52007314): n is a, c, g, or t
  misc_feature (52107639)..(52107722): n is a, c, g, or t
  misc_feature (52187846)..(52187858): n is a, c, g, or t
  misc_feature (52331631)..(52331631): n is a, c, g, or t
  misc_feature (52332195)..(52332195): n is a, c, g, or t
  misc_feature (52333593)..(52333642): n is a, c, g, or t
  misc_feature (52334266)..(52334276): n is a, c, g, or t
  misc_feature (52334695)..(52334695): n is a, c, g, or t
  misc_feature (52339005)..(52339054): n is a, c, g, or t
  misc_feature (52348519)..(52348538): n is a, c, g, or t
  misc_feature (52361338)..(52361389): n is a, c, g, or t
  misc_feature (52361648)..(52361697): n is a, c, g, or t
  misc_feature (52371474)..(52371474): n is a, c, g, or t
  misc_feature (52373462)..(52373511): n is a, c, g, or t
  misc_feature (52491495)..(52491520): n is a, c, g, or t
  misc_feature (52598475)..(52598529): n is a, c, g, or t
  misc_feature (52860301)..(52860349): n is a, c, g, or t
  misc_feature (52912749)..(52912760): n is a, c, g, or t
  misc_feature (52930002)..(52930002): n is a, c, g, or t
  misc_feature (53097109)..(53097111): n is a, c, g, or t
  misc_feature (53102729)..(53102751): n is a, c, g, or t
  misc_feature (53296175)..(53296175): n is a, c, g, or t
  misc_feature (53359933)..(53359982): n is a, c, g, or t
  misc_feature (53428495)..(53428495): n is a, c, g, or t
  misc_feature (53428953)..(53429002): n is a, c, g, or t
  misc_feature (53429706)..(53429706): n is a, c, g, or t
  misc_feature (53430667)..(53430716): n is a, c, g, or t
  misc_feature (53432320)..(53432320): n is a, c, g, or t
  misc_feature (53433682)..(53433731): n is a, c, g, or t
  misc_feature (53805450)..(53805450): n is a, c, g, or t
  misc_feature (53806049)..(53806098): n is a, c, g, or t
  misc_feature (53811229)..(53811229): n is a, c, g, or t
  misc_feature (53811359)..(53811373): n is a, c, g, or t
  misc_feature (53812021)..(53812070): n is a, c, g, or t
  misc_feature (53812705)..(53812705): n is a, c, g, or t
  misc_feature (53813225)..(53813296): n is a, c, g, or t
  misc_feature (53844347)..(53844396): n is a, c, g, or t
  misc_feature (53844698)..(53844760): n is a, c, g, or t
  misc_feature (53847062)..(53847111): n is a, c, g, or t
  misc_feature (53847317)..(53847366): n is a, c, g, or t
  misc_feature (53847744)..(53847793): n is a, c, g, or t
  misc_feature (53848020)..(53848069): n is a, c, g, or t
  misc_feature (53911241)..(53911241): n is a, c, g, or t
  misc_feature (53911789)..(53911838): n is a, c, g, or t
  misc_feature (53913835)..(53913835): n is a, c, g, or t
  misc_feature (53915335)..(53915384): n is a, c, g, or t
  misc_feature (53939018)..(53939018): n is a, c, g, or t
  misc_feature (53939925)..(53939974): n is a, c, g, or t
  misc_feature (53942008)..(53942008): n is a, c, g, or t
  misc_feature (53942297)..(53942297): n is a, c, g, or t
  misc_feature (53948437)..(53948486): n is a, c, g, or t
  misc_feature (53956822)..(53956822): n is a, c, g, or t
  misc_feature (53961039)..(53961088): n is a, c, g, or t
  misc_feature (53965310)..(53965310): n is a, c, g, or t
  misc_feature (53966027)..(53966076): n is a, c, g, or t
  misc_feature (53966423)..(53966474): n is a, c, g, or t
  misc_feature (53966780)..(53966780): n is a, c, g, or t
  misc_feature (53967400)..(53967449): n is a, c, g, or t
  misc_feature (53972064)..(53972113): n is a, c, g, or t
  misc_feature (53972925)..(53972974): n is a, c, g, or t
  misc_feature (53973587)..(53973636): n is a, c, g, or t
  misc_feature (53976594)..(53976643): n is a, c, g, or t
  misc_feature (53976854)..(53976903): n is a, c, g, or t
  misc_feature (53983259)..(53983308): n is a, c, g, or t
  misc_feature (53983783)..(53983783): n is a, c, g, or t
  misc_feature (53984857)..(53984906): n is a, c, g, or t
  misc_feature (53985285)..(53985285): n is a, c, g, or t
  misc_feature (53986412)..(53986461): n is a, c, g, or t
  misc_feature (53988562)..(53988626): n is a, c, g, or t
  misc_feature (53990002)..(53990051): n is a, c, g, or t
  misc_feature (53991796)..(53991845): n is a, c, g, or t
  misc_feature (53995704)..(53995704): n is a, c, g, or t
  misc_feature (53998033)..(53998082): n is a, c, g, or t
  misc_feature (54001375)..(54001383): n is a, c, g, or t
  misc_feature (54016425)..(54016425): n is a, c, g, or t
  misc_feature (54025466)..(54025515): n is a, c, g, or t
  misc_feature (54028600)..(54028600): n is a, c, g, or t
  misc_feature (54030211)..(54030260): n is a, c, g, or t
  misc_feature (54030769)..(54030769): n is a, c, g, or t
  misc_feature (54047055)..(54047104): n is a, c, g, or t
  misc_feature (54049655)..(54049704): n is a, c, g, or t
  misc_feature (54061569)..(54061618): n is a, c, g, or t
  misc_feature (54064741)..(54064790): n is a, c, g, or t
  misc_feature (54065036)..(54065085): n is a, c, g, or t
  misc_feature (54068890)..(54068939): n is a, c, g, or t
  misc_feature (54069166)..(54069236): n is a, c, g, or t
  misc_feature (54069447)..(54069489): n is a, c, g, or t
  misc_feature (54069811)..(54069860): n is a, c, g, or t
  misc_feature (54076549)..(54076549): n is a, c, g, or t
  misc_feature (54077310)..(54077382): n is a, c, g, or t
  misc_feature (54079661)..(54079661): n is a, c, g, or t
  misc_feature (54080959)..(54081034): n is a, c, g, or t
  misc_feature (54387363)..(54387363): n is a, c, g, or t
  misc_feature (54387503)..(54387567): n is a, c, g, or t
  misc_feature (54390657)..(54390758): n is a, c, g, or t
  misc_feature (54410682)..(54410682): n is a, c, g, or t
  misc_feature (54413004)..(54413089): n is a, c, g, or t
  misc_feature (54414998)..(54415047): n is a, c, g, or t
  misc_feature (54415959)..(54416134): n is a, c, g, or t
  misc_feature (54419513)..(54419562): n is a, c, g, or t
  misc_feature (54422065)..(54422114): n is a, c, g, or t
  misc_feature (54424335)..(54424384): n is a, c, g, or t
  misc_feature (54425156)..(54425205): n is a, c, g, or t
  misc_feature (54431501)..(54431504): n is a, c, g, or t
  misc_feature (54439485)..(54439495): n is a, c, g, or t
  misc_feature (54778834)..(54778883): n is a, c, g, or t
  misc_feature (54936883)..(54936911): n is a, c, g, or t
  misc_feature (54937685)..(54937736): n is a, c, g, or t
  misc_feature (54961208)..(54961370): n is a, c, g, or t
  misc_feature (54961454)..(54961454): n is a, c, g, or t
  misc_feature (54962728)..(54962777): n is a, c, g, or t
  misc_feature (54964384)..(54964384): n is a, c, g, or t
  misc_feature (54965905)..(54965954): n is a, c, g, or t
  misc_feature (54968107)..(54968156): n is a, c, g, or t
  misc_feature (54968691)..(54968740): n is a, c, g, or t
  misc_feature (54968952)..(54969014): n is a, c, g, or t
  misc_feature (54974509)..(54974558): n is a, c, g, or t
  misc_feature (54974737)..(54974786): n is a, c, g, or t
  misc_feature (54993633)..(54993717): n is a, c, g, or t
  misc_feature (54994671)..(54994724): n is a, c, g, or t
  misc_feature (54997000)..(54997000): n is a, c, g, or t
  misc_feature (54998992)..(54998992): n is a, c, g, or t
  misc_feature (55019040)..(55019089): n is a, c, g, or t
  misc_feature (55020735)..(55020779): n is a, c, g, or t
  misc_feature (55054814)..(55054814): n is a, c, g, or t
  misc_feature (55055647)..(55055761): n is a, c, g, or t
  misc_feature (55067469)..(55067518): n is a, c, g, or t
  misc_feature (55068972)..(55068972): n is a, c, g, or t
  misc_feature (55069747)..(55069816): n is a, c, g, or t
  misc_feature (55074063)..(55074112): n is a, c, g, or t
  misc_feature (55074410)..(55074459): n is a, c, g, or t
  misc_feature (55074679)..(55074728): n is a, c, g, or t
  misc_feature (55076112)..(55076161): n is a, c, g, or t
  misc_feature (55077119)..(55077176): n is a, c, g, or t
  misc_feature (55084542)..(55084591): n is a, c, g, or t
  misc_feature (55390391)..(55390397): n is a, c, g, or t
  misc_feature (55403043)..(55403043): n is a, c, g, or t
  misc_feature (55739870)..(55739893): n is a, c, g, or t
  misc_feature (55995765)..(55995765): n is a, c, g, or t
  misc_feature (56168397)..(56168479): n is a, c, g, or t
  misc_feature (56168701)..(56168750): n is a, c, g, or t
  misc_feature (56188040)..(56188040): n is a, c, g, or t
  misc_feature (56188773)..(56188822): n is a, c, g, or t
  misc_feature (56189541)..(56189541): n is a, c, g, or t
  misc_feature (56191400)..(56191449): n is a, c, g, or t
  misc_feature (56202241)..(56202290): n is a, c, g, or t
  misc_feature (56203198)..(56203247): n is a, c, g, or t
  misc_feature (56205455)..(56205474): n is a, c, g, or t
  misc_feature (56206904)..(56206953): n is a, c, g, or t
  misc_feature (56207718)..(56207759): n is a, c, g, or t
  misc_feature (56209103)..(56209103): n is a, c, g, or t
  misc_feature (56213466)..(56213498): n is a, c, g, or t
  misc_feature (56215119)..(56215121): n is a, c, g, or t
  misc_feature (56216848)..(56216897): n is a, c, g, or t
  misc_feature (56225308)..(56225308): n is a, c, g, or t
  misc_feature (56226485)..(56226534): n is a, c, g, or t
  misc_feature (56230591)..(56230677): n is a, c, g, or t
  misc_feature (56239919)..(56240014): n is a, c, g, or t
  misc_feature (56356897)..(56356907): n is a, c, g, or t
  misc_feature (56478019)..(56478068): n is a, c, g, or t
  misc_feature (56514754)..(56514754): n is a, c, g, or t
  misc_feature (56522614)..(56522663): n is a, c, g, or t
  misc_feature (56523645)..(56523694): n is a, c, g, or t
  misc_feature (56525598)..(56525647): n is a, c, g, or t
  misc_feature (56684417)..(56684466): n is a, c, g, or t
  misc_feature (56685181)..(56685230): n is a, c, g, or t
  misc_feature (56686063)..(56686063): n is a, c, g, or t
  misc_feature (56686400)..(56686455): n is a, c, g, or t
  misc_feature (56686602)..(56686651): n is a, c, g, or t
  misc_feature (56701371)..(56701371): n is a, c, g, or t
  misc_feature (56895093)..(56895142): n is a, c, g, or t
  misc_feature (57061533)..(57061535): n is a, c, g, or t
  misc_feature (57405073)..(57405075): n is a, c, g, or t
  misc_feature (57579750)..(57579799): n is a, c, g, or t
  misc_feature (57581064)..(57581113): n is a, c, g, or t
  misc_feature (57581705)..(57581754): n is a, c, g, or t
  misc_feature (57585263)..(57585312): n is a, c, g, or t
  misc_feature (57670800)..(57670847): n is a, c, g, or t
  misc_feature (57671032)..(57671081): n is a, c, g, or t
  misc_feature (57693386)..(57693499): n is a, c, g, or t
  misc_feature (57730593)..(57730594): n is a, c, g, or t
  misc_feature (57764767)..(57764771): n is a, c, g, or t
  misc_feature (57861106)..(57861106): n is a, c, g, or t
  misc_feature (57959046)..(57959080): n is a, c, g, or t
  misc_feature (57960027)..(57960076): n is a, c, g, or t
  misc_feature (57960489)..(57960572): n is a, c, g, or t
  misc_feature (57961985)..(57961985): n is a, c, g, or t
  misc_feature (57962825)..(57962874): n is a, c, g, or t
  misc_feature (57987434)..(57987483): n is a, c, g, or t
  misc_feature (58004195)..(58004244): n is a, c, g, or t
  misc_feature (58004795)..(58004844): n is a, c, g, or t
  misc_feature (58005064)..(58005113): n is a, c, g, or t
  misc_feature (58005322)..(58005371): n is a, c, g, or t
  misc_feature (58005601)..(58005707): n is a, c, g, or t
  misc_feature (58007513)..(58007513): n is a, c, g, or t
  misc_feature (58009368)..(58009475): n is a, c, g, or t
  misc_feature (58041355)..(58041355): n is a, c, g, or t
  misc_feature (58042719)..(58042768): n is a, c, g, or t
  misc_feature (58047305)..(58047305): n is a, c, g, or t
  misc_feature (58048201)..(58048250): n is a, c, g, or t
  misc_feature (58066867)..(58066916): n is a, c, g, or t
  misc_feature (58067805)..(58067854): n is a, c, g, or t
  misc_feature (58070881)..(58070881): n is a, c, g, or t
  misc_feature (58073757)..(58073883): n is a, c, g, or t
  misc_feature (58083246)..(58083295): n is a, c, g, or t
  misc_feature (58086908)..(58086957): n is a, c, g, or t
  misc_feature (58088108)..(58088108): n is a, c, g, or t
  misc_feature (58262678)..(58262727): n is a, c, g, or t
  misc_feature (58337419)..(58337438): n is a, c, g, or t
  misc_feature (58755143)..(58755163): n is a, c, g, or t
  misc_feature (58772890)..(58772902): n is a, c, g, or t
  misc_feature (59032092)..(59032104): n is a, c, g, or t
  misc_feature (59208160)..(59208160): n is a, c, g, or t
  misc_feature (59209252)..(59209301): n is a, c, g, or t
  misc_feature (59210424)..(59210424): n is a, c, g, or t
  misc_feature (59219879)..(59219928): n is a, c, g, or t
  misc_feature (59235256)..(59235278): n is a, c, g, or t
  misc_feature (59289326)..(59289334): n is a, c, g, or t
  misc_feature (59312954)..(59313003): n is a, c, g, or t
  misc_feature (59342422)..(59342422): n is a, c, g, or t
  misc_feature (59345314)..(59345363): n is a, c, g, or t
  misc_feature (59351495)..(59351503): n is a, c, g, or t
  misc_feature (59390843)..(59390843): n is a, c, g, or t
  misc_feature (59760567)..(59760567): n is a, c, g, or t
  misc_feature (59777457)..(59777457): n is a, c, g, or t
  misc_feature (59911828)..(59911877): n is a, c, g, or t
  misc_feature (60020214)..(60020263): n is a, c, g, or t
  misc_feature (60025913)..(60025962): n is a, c, g, or t
  misc_feature (60363204)..(60363219): n is a, c, g, or t
  misc_feature (60475142)..(60475156): n is a, c, g, or t
  misc_feature (61118078)..(61118078): n is a, c, g, or t
  misc_feature (61204244)..(61204259): n is a, c, g, or t
  misc_feature (61307438)..(61307487): n is a, c, g, or t
  misc_feature (61316814)..(61316856): n is a, c, g, or t
  misc_feature (61327128)..(61327177): n is a, c, g, or t
  misc_feature (61328060)..(61328136): n is a, c, g, or t
cgtcgccttctggagcgtctccctcggcctgttcctcctcgtccggcacaagccctccaaggccgtcgacagccgggcccccagcagcgcgcataccccgtggtcggtcggcgagcggatggccgtcacggtggccggggcggtggtggcggcgctcacgtcgtggagccggatatacctcaactatcatacggagaggcaggtctgggccgggtgcatcaccggcgtggtctcggcggttggatggttcgccattgtgggcattgcaaggtacactggatggttgagatggggcctggagactccgattgcgagagcgttcaggctgagggatctcgtggtcgaggaggacccgtgccagtctgggtgggagaaatgggaggagagaagagtgacgtctgacttaggcaagccgaagaccaattgattctgtgcttgatctctctcggcgtactaggttcatctttggctgtgaaaccgtgcggattattgtatggtcttagaacataggcttcatgaggttagtcatgtgggttactaggtattaaacatttatgaagttctgccatagtctacttgaagaatataggcttgcttacactaaagcctgtttacacggaggcttgttgatactacgatagtactcagtcgtattatagccgtctatcgccctagagttgcgtgcgatggtttaaagctctggcttgaacatgccagtggctacttaacacgacgaacacgacagaaatcatgccgtacagaaacgtacagaaacacttatgcaatcaccctacgttgatgccgacctcattcgtgcaattaagcttccataaaacaacatataggcaaattggtgttattgcccttcagctcgaaagcatgcgctaagttggaacgtcgatcaaacatgtgaaggatggacgggcatgaagcttatctacatcaaccttgccgtgattaacaattccacgtgaaattccatcttcgaggcactaaagaagtataatgataacgccgctgcactctttgaatgaaaagctacatcacagctggtgcaatacctcctcgagggccagcaggcattatgtcatttggaaagagatcccggtgtaactgatacatcgtcgattactgtcagcctagtctgtgaagaggtattaaaactgatttcggttgcgttcagcctcattgtgtatgacggctcagggcggagtggctgctgctacctcaactgtgcataaccggggcaagagaacaattgatgcctcggtccttcggtggactagagtagatatctcgaaactccgtggtatggaccgtcataggactattgaatgtcatacccagactcaacagatttctcctctcgaaatagcacgatcacaagacaaacttgcaatgcttgcggagagaatcctccgctgtgatctcgatgggttgtgcgaacggccgtgggagctccaggccccacatatatgcgaatgatgccgtcatcatgattttagatggcaactgcaagagctaggcagccagtgagaaagcatcacaggcgactaaacccggctgcacctgttgcatgtggcaatagacatcatcatgatgggcgcgttgtttgttgaattcaatcgaagcgcccggtattgtgtctccacagcggggtgcctgatttactacgaactcgagcttacaattcaattcacctgacgtcatacctgatgcagaattgcccggagcttcaactgcgatgcatatctgtaaatcaccatagcttagtttggacaatgacttggctcccggccgtactccacaatccgggcctttgacatacagggacaaaaggctcctcgggacatctgtgtacatctcgcttggatccgtcgaatcagagaccaccccccacgcaatgaaggtagtaatctatgacgcgatgatggccgttctttcacatgatgcgggttgttcgcagttgcccctgtgaggtaatggctgcaaggcagagtgaatgagtatgctttggggaagtgacgatggccaattccagcttaggtccgattctgcgctcaacacgattgtcattgatggcaccagacacgcatcgttcctgccagtcttgcgtagacctctctgagcacccctcctctatttaaaccccaaagcctgccctccaagtttcgatttcttttcttcttcatcacctcaacaacttcaaagctcaataccaactcaaacaaacaaccaacttccaccactttcaaacaaaacaaacccccaaaccacattcacaatggattccatcaagcagggcgccaactacgtcaccgagaaggtccaggaggccacttccggcacctccaaggaggccaacaagcaggtcgctaaggacagcaacgccaaccttggcactcggtgagttttcatcaatatgttcagacatgttccataagacgtgtgctaaccctcattacagcgcttccgccgccaaggatgccgctggcgacaagctccaggagtcgaagcatgaggccaagggcgaggctcacaaggaggccatctaagctgctctctttgagctttccctaccgacaaatgtcaagacaacgtcaaggagtctgggattggaacaatttttggaacgacaacgatggagttgcgattatgactgtgctttgatgcactagaataccctacatagttcctggcacgaaatcaacatccagttaaacatcatttatgctctatgccactgtgactgccatgtttttctacttgtgctataccaatagctcatcgtagatgtatgtctactatgcctgatatattgagggtcaagtacgcatgctacaggttcttcttgattttacgctcgctcaaggctgaggagatgtccccaactgcccagtatatagcgtagaacggaatgaaaacccagagcatgttgaagaagaccagatacacccacatatacatgaagttacttccgtcaagattgagattgccaactaaccactcagggcagaatgtcatgaatcctacgcatcgtaatgttagccaaatgatgatgccgcctcgcctggttccatcaacctggccggggaagttgaaatacgaacctccatatatttcacaagtagcaagaatgatcatccatatactagtcttggggtcccgcttagcaatgcaatagcagatgtatagcgccagcgttccgtcaaagaagacagtcaacagctcgagactgacgacgccgagatctacaccggcccatctcttatcagcgcgggcatagaccatccacagctgggcgaatgggttgcttccacctgattgggccccatagacacggtccccgccgtgtaggaggaagttgtacggtgtgggaaagaggccatggtcgggggccagctcggacgtgggaatgtaggagaagaagcagtggtagaggaagctaccctcgaggatgaagtggcatagcgcgtcggcgaggtgccagatgaagaagaagcggagcgtgcccgatgtcgacttggagaggacgagcttggaggtcgagtacgcggcgaggacgatggccacggtggccagcagggagatgacggtggtggtgtcgaataggtcgggagggagacccgaattggtcgatgaggcttgggatgccatgtttctcgatcgaggtgtctcggatggatcagatgcccgctcaagggatgtgtggcttgttgttggaagcacggatattggtttcacatacagaaatagagccacgaggaggatatccaccaccagccgagctcaattaattttgagggtcgtcgcccacaacggcttggtggattttgagggccgattcaggggccgcccgcaccaggatccatgccgtcctggtacgttatgtgtctgctacatgttggcctactgtgatgtgctctggatttgtgctattaagaattaacttcagctctgtgcttcacaagatgctgacttggaataaacgaactcaagtcccagctggacgataagattggcttactataattaattcaccttcctgctggtagctgtgaatccatagtattactatgatggaccggatggaagccacatccgaaacgacagggctgtgtatgacgttgactcactgaacgggcgtttcctcagttcatattcagtaactaggcatgtgtctgtctgtctatagagaacacggcgtacaatatctgactgagcggaacgggtatatgtctggaatgccaccaatccaagcagatggccctatgaacggcctcacacccgcatagagaacacgcatcacagcaagctgctctctcaagtccatctgccaatctgtgacgagcatcatccgcctgcagacggtttgcgtcagtaattagcgctggctcctgcgccaatcatcccacctacccgccagatttccggtctgctccagtcaccaagacaggctccgtccccgaatgggtcctagaagcctccaattagcacagatagcttgattctaatttggcgacctaccaccaacacccttgcttgctagccttgcggaacagtagcattgccggcttctattcaaagctgcggctggtaaatggtaccgccgtcgcttgtcatcagccagctattcttgggcgcaagaagacctgttgccgtggtctctcgcggcatgaaatggcatgacggcttcgcaacttcatcgctgacgcccagcatggggacggataataataccactagctttagtggacttgtcaacctcagcttcaaactaagctgactcttgtaatggcaagctagtagacgagcaatcctttgttgctaatcctttgctgctccagtctgctgaatgcttcttaaaaccaaagcctcgcccttccgtattccatcctgctcttcaacctccacccaggtcccagtcactccgagcgcgttcttttctcgcagtacatccgcttacgtgaagatcattggcctcttacgttgaagatacccctctaagtgctacccgccaaccacagtcagcccctccaccagggtccccgaatcaggacagcttgctgggagcatcacttcgacacagcccgagcgttgtttcctgcactattccgctcttcgttcttgtcacatttcctgtctcttcgattaagctgccgaaatccttctcacaatgtcgaacctccgttcatcagcgttcccccagcgcctgtccggcctgtcgcagagccaaagcgccaacgaaacctccagtgcgccctcggaccaacgtgacgatgcgaagcgcaacatgttcaagaacatgcgggctctgcccactcagcactattgggatgtctattttgacgggtgagctttgataaaacatcttcctgggcttcactcaaccctcgtgaacccatgggtgaagcctgttggccaattagcgtgctgaccgtttttgctagacaagcgagagaccagaaggaaggtgaagaaaactaccactcgaacctagagaagctagatacccagatcgagtcggtccaggacttctggcgctaccacaacaacacccccatcgaccagatcaagatgcgagagtcaatctacctcttcaagcagggcttccgtcctgtctgggaggatcgccgtaatatcactggtggcagctggacattccgtgtccccaagactgcgggccccgaattctggacgcagatccaactcctggctattggcgagaagctccagggcgctctagatggaggtgagcttgattctgtaatccccgtggcaaagtttcatcccttttcttcctcgagtaaaggacggaagagacggatttggtacacaaactagaaaatgagcaaccggctaacaccatgtctctagatgatcagcttgcgggcgttggactttcggtccgtttcaactcgcacctcatcaccatctggcaccgcgagggatcccgaaaggcctcgatcgacggcctcctcaaatgcgtaatggaagagctccccgccgagttgcagccgaagcccgacacctacttctacaagaagcactctgagcacgctggcttcaaggctccacctgagctgcaggctgtcttggattcccagaagagggcggaagctctcaagacccagaagaagcagcagctgcagcaggagcccattcctgagtaacgtctcgatatcgaggcccttttttcttttcttctcaaacacattacttcttcttttttttctcttcttccttttcttcctttcttccttttctcttcctttcttcctaggctacgtgcctttttattcaattctctgtgtggaataccacatttggaaacgaggttcatcatcagcatatgagatcgataatgtaacgagagcgaaggcatcgatctggcgtttttctttatagttgggcggcaaacatactagggttaaatagaccatctattttgtcttttgatttagctcagtgaaagactactcaattcattcccacctctagtgttcttcaactgttcacgttatctgtgtcccatagtgaaattgtcggtggctagagctgttcattgcgaccttttgcccttcctttccacggtggaatggcaactgatctcccggatttgacatttcccaggggctttgtacgtgcccaatgtatgtttcttttgttaattctgctccacgaggactatgtagccataccaaacttaaatgtcaaacaaactgcctgtcactccccccaacgccacgcgagaagccaaacgccggttataaacatgatgaccccatgcatatacgagaaaacttacacagaagatgccctcctcatctccatacgccggcattcttcatcacgccgtcaaactcagccagctcgacccccctcgcgacgcccgccccgccgttcgcctccaggatcatgtccttgagcacctcctcgtccacgtcctccttgagcacggcggcgacgcggcggaggtgggccagcgttatggtgcccccctggccgttggtgaagagccggaaggcctcctcgagctcgtggcggtgcgcctcgtccgtgtcgtcctcgcgcgagtggaacttgagggcgcagatggcgaggaacggctcgtacgtcgcgaagccgtcggactcggggtcgaggatggagatgaactccttgagttcggcgggcgaggaggcggggatgccgagagctctgtgatgcgaacgttagcaggggataggacgaatcacatgggagcgcaagttacgctgagggggggtcccctacattagagccgatttgaagtcgtcaatcgggatgactccgttcttctcgccgtccatgggctcggcgaagaggctgaaggcctccttgatctcgccctcctcttgcgccgagatgttgtgctcttttgcgagcttcgatcgcggtggtgccttgggtgcgctggctgcggccccggttttgcgctttggcggctgttgatgtactgttagatgagatttccataggcctcgtattgaggaactcactcaccatcttgttctgtgacacgccctggggctcgatgtgagtatatgcttgacggcgcacatccgctttctggacttgctatcagcgataagatactgagacagtgttaagtatatacatatgagaaataacactgtgtacatattacctcggaacccattgaaaaaaaaaattacttcagaccttcaacctcattcaccaaagaatcgctttatgacctcttcaagtcaaagcacagccgccagaaatgctacgattagctctccagctctcgtcataacttgcattctcaacggcccgacggtaagtctgcagtaggtccgaatgacgacacccggcgctggtcaaatccaagcccaaaaaactccgcttctaaaaatgctagagcttgccgcctcctatgtcccagagcgagcaagtgtggacagtgaagcaatattgaaatcggtccgtcaaaaatgacggatgtccagagcatcgccagcggcgccgctgtccttggtgacgggtgcctcgcggtcaatggagatatttcttcatgcacaagtggtgatttgtattttcgtcgtaacatgagcatcatgggacataacccaggcagcgctcttcagctcaattgaaataaacacctttctcctactctctgtaatctcataaactgtcattccccccctcgcacctggccctcgtccatatccttgccactgagaaacatactcatatctttgcctctggtggtctggtcggtgttgttagtaccatgtccacacatggtgtgacactggagggcatttgattacttcctcacttgaagttgttcttcatctcgcggagcttgcccatgacgctgaccgggtcggtctcgcccgttgccttttggatttctgggtcctgttgcacaatctggtcagcttcttcgaggtgctttgtgaagcaaattcagccatacctcaactctcatgaacacgttgtgtttctaagttttcacgcatcagttcaatatattcatcaagctaggcagaacgtgtcatgcatgtagagtatcacaaaccttttcatcaccaatggtgaacttgccggtcgtcacttggttgtcgtcggcaaacgcctgcaacttcttgatcgcatccgtctgggagacggaaacggtgaacttgacgttggacttggtgtactcatggccgggctatcctcgcaaggtttgttgggtcagcagatgagtccctcaaactacaggcttcaactcctagtttgcatccctcgggggcgggtgttcaacgcacatagacaacagtctcgtctgggagggctccgaggcgcttgttgagagcctcgtgcatctggtcagctgttccctcgaagaacttgccacatcctgtgaaccagtattagttgtctgttgcttgacttctgttttcatcccagtccaagcatgttggggaatgaacaggatgcttaccgctgatgaagagggtgtcaccagtaaagacggccttgccagtgctatcctccaggaagtagcagatgctatcctgggtgtggcagggagtgtagatgttggtcaccttgatatcgcccagcttcgtgacttcgttgtgcttaggagtctgtgttactccctcgcaatccttgccaccgatgatagtcaggttgggggtgccgagctcagcaagctacaaatagaccatggtaagttcatgtttgaaaaccttgcaatatggcaactatcagactcacaagcttcttgtttcctccagcatggtcccaatggctgtcgtatgttaattacaatcttgtatcgagagtctcgttgttgttgttgggttctggacatactggtgggtattgacaatggcagtcaggttgatcctgccagagctgatcgcctccttgagcactggaaccaccctatcaggcacattagaggtcatgcaaaaacgggaaaatgcaagcctagaacttcttactcgggagggttggctgggtcaatgatcacagcatccttagacttgtcatctataacgaggtaagagtagttattactacttcccacccctgcattgaccgtcaattagtttttctccctttgagtagttttagatgtgatatctctcacgagatgacactaattcacgaatactcacatagtggaatagcctcgatatgcatggtgcggatatgctgaaactatgatgtcagaacaaccgccggtcagccttcagatattcaaattccaatggaactggttgagtctcacgggccgtgcaatctgtctcagagggaattttcgtaatgcgaagcgattcatcactctacgagaatggcaggatggtggttgacgatgctctatgttggcataattacaaatcacctatggtgtaatgtaatgacgttggttggtggaagtccaaacgcggagttacagtggagcaaacagccaaaatcgcaacgaaacagcgcccatagcagcatgctcataacatctctatttcctgtttacgaaaatcgatattgtaacatcgactacggcgagcgttgcagtgtagaagggcatatttcagagcagcaaagtcgtaaccggatacatgtgataacttcacttgcagaagagaaagctaaacaagcagtcatatcacatgctacgtgggaatatttatgggtatcatttatctcacacagcgccaattggcttcggtttccaatttccctggtataccgcccaaccggcggctgacgcaacgtcttggggatccgatgctgggtcagcggccggagggaatggctggggcggttcctgatcctcctcgtcctcctctgcttccacgaggtcccgcgacaatcgcatgcatttaacatatgcctggttgcctggcagcgtgccctgcaggcgggcgaggcagctgagcagggtgccaacatcccaccgcctctccagtgcgaggcggcttctcctgtcggcattaggatcatggtccccttcttcccgcaggtagcgcagcaaagcatcctcacacgtttcagacagcaggtcatcaccagccaggtgtctccagtagtacccccaaatccaccgtagcgccttcttggctgcagagcgaagcttggccagggaggggagctgttcatgtgttgactggtgcctcagctcaacgaaagtagccggcagaccaatggtcctggcaagggagtacatgctctgcttgcgctgcttgtcctggtggccgtccaacaaaccggtgacgaatctggagagtggagccgtccgctcatcagcaaaggttcaaggtgaaggccgaaactttggtccgtcacaatagcgcattcagctcagcgcttggtaggaagcggccgagccaggcctgggccatgtaatgtaatgggggggggngcggtatagagggtaaaacaggcataaaacaggtctggtgcttggaatcgatagcgtcacacttacctgctgaacgctgctgagtaggccgctcttacggcgtaagccgacgatgccgtcacattatcgaccccggtcgccttcgtgttcaccatcagctcctcgtcgctcagcaccgctgccgtaagcagggccgtggactccaccatgtgcgggcagttgccgcgctgcatccacatcgacacccgtgccacggcctgatgaagttgcagtcgctggttgcgtctgagcctctcgacgcccgccatcctccgacaccgacgccgctcctgctctccagcttcagggctgccaagatcatctttgccctcttcgtccccctcgctcaagccgccgtgcttggtggtatcttggtgccacatacggctgtgctctccgagccatgacggagacgcagcatagaattggtgccttacaagaagcagctcctccctgtcccgccacggcgtcaggatgtacttgaccatccctgtggtgtggtcgaaaggcacagagtgatcggaagggggcaagaacttgtgagaggaaaagaggagtcttagaccggtgtgtgatttgttggcgctgagttgagttagacgattgggcgtaacgtagttgaatttttcagctccttcacagctctgtcttgtccttccctgcgatgaatttttcgcggtctcctctttaatttggttttccaccttctcgaacagagctagaaggtataaaaaaaattccaaaatgcagaaacatccacaacaagggtggtcccagaggagaggggctagttgcccaggactctggcggtctcagtctggaccgatgtcaacctcatcttattgccttcaggccttgctgcagtgctattagtgtgacatggctggcatgactctccctcctgggacttaggtacctttagtgtgtaagcgcccactgacaccgtcacacagagggcggtacagagggtgccttgcctgccgcctgggtacctgccggcctacccaatatactacggttaggcaggtagtattacgctctggaccacctgaggtgctagcagctgcgccgatccagcaccttcaagggcaaggagggatggaggtaagcagccggtcccatcaccagtgtcaatgggcttaccgcactgagacagggctcccaataaacgactgcaacctccatacgtgacctaatatatcctggcgtaccgctgggaggaggccaaccatgctccatagtccctccatgatcctgcgcgcggccgaaatgatgtatgtatgcatgcatgcaccttttctcgcaagctggcccaaactagcttttcgacatgccttgctggcggccactttcggtgcctggcccatccccatttcccgagtacgcaagccgaaactgacccgcgactccgcacctgaatgagtgagaaaagaagtctccacgatccgctctgtcctcgtttacaagtccgaatcccactgcgttgtcttgaccacccgcctccatgcgatcccagccggactacattcggtaatgacattgtgagagaacatcgaaatgattctgatcccgggcgccgctgctgtttcatcgtatcctaagcccgaaataatatgcaacacgtattttcagacatgacacgggtccttcctcggcctttggcatgctctcggtctattctcctccacagacaatgcaaggcggggaggggcccaataactgaagtcttgcaattgccaacgtggaccggtcgccggagcatacgctgatcccgcctctgcatgcctcccaaccctttcgccagtgtgcccggtgttacaaatgacaactcattcatgagctcgtcattttctattgtcgcaaggccgagcttggcgacatgagtgaattgtgcgttagaccggtagctctcaatcttggaagcgtacgcgtcgttcccgtcgcttgttcttgataaccattcttaccaccctccattggacctggcgggtgtgacaatcacagtgcgtcgcgtacttctgaggggaggtgctttttttttcggcaggcaggtgaccaacccaccgttaggtaaggcattatggattatgggcaaagaggagccagaagccacacccatgcctacggtggcggcgctggccatcatcgcgatgcaaaaggaaatgggcttagcccagcgcctaagacagccttgaatgatcgaccacgctggacgggactgccgggaggaaggcccaacaagtggtcgaccaccaaaatgatttggttaggttaggggtaggtattaaacagggcgccggcgcgctcgacaagggtctacgtctcctccgaggcaggcttgcccaaggctatttcaaatatgtacgctaccttaacaggtgaaatcaacgaaaattatgttttgcacgccccccccatccctccacctttcttttctctcccccaccaaaaccgacatcccctggagcgccctagcaattcgtgggtgggaaggctcgggtccctggaactgggccatgcttctttcgtatcacacagatctaatcagccgaccatgcactttattacatagagccgggctaagcaaagtcgtgataggcggcttggcggcagaagccactctctctgctcgggacgcgataggcatgaaaattaaaggccaactcgcgagtgacattacgtcgctctcgcctagactctcgaggagccgcgaaggtttaggcccgagtcattatcaacaccgggcctcttaccagcataccgccctcctctacgatgaatagaaagttagaaagccatcaatgcggcggtcacacacgggccgcgcccccgaaatgtgtgtgctgtgtgagctgcgctttgagaattattcccccccgtagatgtcgccccccggggcagctcctgcgatgagtaagtatgcgagctgttccatcagacacagaccgaccggtggtggttgtgtccacacaccatccctggagaccacgcagcctgatgtaatgggctggttttagagaggaggaggggagggccaccagcgacgcacgtacgtccgagcacaaacctggtaccttgccggctggcctcgccttttggtccccccaagcccagggagcgagaacgcggcaagtaccatttgccagccagtcatagcgcaaggcaaggccgggcatggtcccatggcggggtcggtgctatttcagaagccaccacgctcgggtgagggacgcagaggccatgcatgctgccccccaatcaaacccaacgcgctgcactgactcgaaaggttgatagcgggaacatgggccgtggtcgtgcccaaaagtatggaagaggagggggaggtgaagggaggggggcgccatccttggctgtcggtcgcctgctaagatcagcctggatttcatgctcgcctgtttgctgcatccgacgcggcccagcgcctgctgcccatttgctccggggactggaatgatctcgttttcccgtggcttacggcggaatacatacctaccctgcctccttgggattttattgtcgttgcctgtcattccggcggtttctgcgaacgccagacgccacaaacaatcgaggaatgccttggtggcttgacagcccccccccaagccacggcacgcggtggagaataatgtggcgcgaaaaaggccgtgagcgacgcatcttcgaaatggggaattaagagaaaaccgccgccagggtgcagggtgcaggggtgcaaaaggaaccagcgggggtgagtcgagagtttgggatttgccatccaatcaaggcccggcaaagtcagctagtagggatcgcacggacccggcctcacatgtctgacagggatccactggcggctctgttcgcttgattagcgtcatcgtgggatagctggtgcatgaaagcagttgctttggatgaacgaggtctgtctggagtgttggctcgtaaagcacgcagagtgaaagtcacggttcaggttcagctggtactgggtttggtttgtattgctccatttgtggggttctatctaataaaattcaataatcgctagtttgagcctgggtattcatgtcctgataatccgctcattgcaccgttgcgggcgcccatacaatgcccatcccaatgccattcctagtttaaagcgccagttgaataattcagtcccaatgtttttttgtcgtcaatcatgccagtatttctgatccaatccagttggcatcaggtgcgtaggttttgagttgaagtctcacttatgcggaggcatcctcatcatcctcttcctcctcgtcatcctcctcctctccatcagaggtgggaggctcccaggtttcctcgagcttcaggccctttccagtgggttcattggcacggtaggtggagctgaagagggaagaagtagtagatcgatagttgtttagttgaggatcctcgtcatatttctccggagcatcgtaaagacccattccaacaagaatctccccctcctcctcgggctcttccagtgtgtcatagcgaactggattttcagagaccgcgggctggggctgttgagagtacatggtcgagtcgggagtaggaggcgtagtattgctgagaccatgcatgtatggttgccattcggtggactctgcgacaggcgtctcgttggctgggagctccgtgtagatggggaaatatgatccattgttgttggtgttgatggtatcccagccagtagggttcagatattgggggacattgcctgggtactcaacaggaagaggggagaatccagatgagggagatgtgtcgggtgaataggaggtcatcattggtgacagctggggacatcctgtggatgcgtcctgctggtcaggaaacagctgagtggtgagagggtagtattgctgcggcagttgatagttggtctgaatcccgtagaattgtgagctgggatgccagctaacaggtcgtgaggttctggggtttgctggtcgagaaatgggaagctgctcgggtacgtgttgtggccgcttgtagaattggttgtcgttgacaaccatgggtcttcgttgagatgcggcgggtcttcttgggctgttgttggcgctggtgggcttcaccactctcatagatggtccagaatattgtacactgcttcgagatcgtcgtcgagatgcttcggaaacagcttgctgcgtagcccaggtgtcgagaaaggcatcttgtggctccatgggcagaaaacccggagagatgcccccgttgagagaatacattatgggtggtgtgggtggcggtatgtgatgtagagaagcgtgttgttgtaacggtgagggaaggaaataagatgtaagagaggggatgcttggttttaaaaggaaacgctgagaagaattaagaaatgccagagttccttggagtagtcagatgtccggtcgatgaagagatggacaagccctgggatcaaatgggttatgtatcatagtccggaaagacattggaaggcgctactatgaggtggttccctgcgccagggagtgagaaaacatgtgccacattaggatggtctggagaacaataataagtggctacatattcatattagacctagtcgtagtcggatcaaggccaagtcggccatggatggatctggtggcctgtgggccgtcgagacaatagacaaagtacttgcaggcgagaaataaaactgaagtaaaaaaagggcgacatgggccatcaatcactagcatcgtaatgcgccagccagcaaacaggcccggcgggttgcatccacgggggagatcgaagcgactgcgggtcccagcacaggggggtcttccagtcccctggctacgactgcgctagccagagttgtgcatatacaaaacctctttctgcaggattgtcttttagcacccttaccgggattggcattgtgattgtggatagaagcgtgtggtaggccgggagtcaagtggaaggctgcgtcatatgggtccaagcaggggggtgtgccgaccggattccgggctagaaatggaaacatgaatgagggatccatcatctgctctggttggtggcccggcggaggcgatagttcgaaagcgcgcgttgattaatgtgggtggacatgcgttggagaccagcctcttgatctggatgtaggtacctacataatattatggatgcacacacacacgctgttggtgcccactcgcgagtgcggacgacaacgacggccttgaccatgaccgtgaccgggcttgcttgcggcttgccagtctgatggagctatcccatcccaggcccagacgcatgcacaacgcatgtgaggcatctttgtccacacaagcccagtggcagcctctcatcgtgtgacgggagtacatagacacgcacgcgcacgcacgcactcacacaacaccgtagtattcgtccggggggggaggcaagtgagcatgctgagatctcccatgtgtctcggaagccttcattacaacaagggcgcatttttagccaggcaggatggccccctccggcccaagacatcaatcaggactgctcctctcggccatggcaaggctcaaagtctcgggtggaatgtgacgaggaagcgaaaggcaaagtttgctcaggcaggcgcttaggttgatttgctcggggtttcaaaaccagacagcatcgtgaagcgatggcaacctgctaaagggagtccactcgaaccctaccaagcccctgtcggcagccagcgcaagaatagagccttctcgacctgtgagactaaccaggcaggctgcacatggattctgcccaccccaccagaaacttcccgcgaaacgttatcccttgccgctctcggatccatccaagggatggggaagggctttgggtgcacgctatgggcgtcgggctagaacatcggctgtaaaggctgcgcggccagacatgctggctgtccgcctcctggcgcgctgaccacagcaacggggggtgtccgcatgactgttggcttggggtcttagtgtcgtgccctgaaggtggtttgggaacgctccaccgggagaggtggggatccatcgatgatttggggactaggtgtacaacagccttcacgtccatccatgtggattccagaaaaatctactttaggtaggatgtgaatgtgagcctgggccgggattggcccatcgggtcagcctgtctcgccaccccccttcgatacagatatcagggacacctcctcggatacacagcacagattttaaagtgatagggaggagtcggagtgggcctatcatgcaggaatgaagacgtacactttcgaccatacgtttctaatcatatgtacaaagccaggcaacttggggagattattctggccaagaggtccagtttagaagccagcgatcttctaacgtcatttgttccgcacccccattgcaggccggggcttggatgactatcctcaccaaatccctcctctgcggatagtaattaaattggccgttggttgtggaatgtgcatttgggagttcaaaagggacatcggcatgtaggacagggagcatgggcagcagagcgcttctgcaacttgtagcaaaaacaaaaacaaataggaggcagagccaaaagaatgcctgacacgagtcgggtgggcttgctttcacagcctgtacgacgaatgatgctgtgcatctgcagattgctgttctcaacgtagcgtatgagccggcggagccagatgcggtgacttattattatggctcccagggattcaatagtgaattgatgctactgtgccgccaagctgtggggaggaagaaggaaaacttgaaagggtgggtgatgagctcttggtggagctgcaggtctcgccaactggacagcccggcctcaaggatcacaaaagttagcgggtggcttttggcgcaaattgagatagcaccacaataagcagggacgacacatatgctagcagaagaacttttctactactatttggagcgagcgagaattaggagtagaagtactaattacaattatctaaggcaaggtaagcatgcgagaaaatagactgtgacgatggatcttctatccctgatggccttcggggtcggcgctgtacttggatacgcaggtatatgggtacatgcgggcaaggtatgcgtccacacacaaatatgtacacgcgcatgtactgtgtacacacagtcaatctcgggcactcgctctcccacacgagctggagccacaagcaaagttgagacgagcccagtgaggcggagcggaaagagctggtcatttcctcttctggcaagtgtgaccctgcactccctaacacagggagtaaagggcaacctcaccgcccgggcgcctaggaaatgtggggctggctccctcggagcgaagtggacccaatggtcctgctcagcacgggagacgaggtgattgatgcattgaagcgaaaccaccacacatccatccatccatccacagccatccatcacagattcgaggaactgcagtcagctgcactgtgcagtttgtcgccgccatcggctaatacctgaggtcggccagatagaaacacaaggtcgatgcctacagcgacaaggttccggtctatgaccatgacatccaggccgttggacccaacacgacattacattagcataccaatacgaaaatctacaagatcatcaagtaccgaatcttagcgaacgactgtgcaacttccgggcgaacattacttcatagttccaagtggatctgatttggagcatcatagaccaggacttgcgccctgagaataggagcgactccatgcgcctgacggccacgtcaattagcagagaaacactgggatgagggcgataaccgcaagattgactggtcagccaatgagctgctccgattgctagtacgtggtagccgatgcgctatggcttcattaggccgctccagcaaaagaaaacacaatgcacagagatgactggcagccaagggatcctccttcaccaagccggttacttaggcataattgtcccgcgctctgctcatgtcgggtcctttctttttcccctctcctccccttgcttgtctcgtttctactggaccccaccgtactaccctgccacaggaacagctgagactgagcccgctgagggatcatccacaggcatagttcgcctgctagcggtcttagcgggctaattatactgggcgcctccgcctgaaaccctttggatctgctgttgagtgccctgttcgacctgttttgtgccctggcgacgcccccaacccagcccagagccacccaccgtccacccattgtgctccgccagctgatgactgcagtgacccaggcaggcaggcagtcattcctggccctggctttcgaaccagaagtggaggcctgagagggtgatgagaggacctttggctggcgtcgcccacacacatcccatccacacggccgcctggaacccaacatgatgcatatctgaggtcactcctcaatccgcgacggctccgttccccgatcctgacggcggtggactgcaactctcatttcacctgctgctggtgtcagcagcctaagcatgcctacgacaggcagcctcccaggcaaatctgctctgctgcagcggggcgccgtctgtcgtaccagcctaagcaggcagtgatgccgctccatcatctccatttgcagtgctgaatgtcacccctttttttttaacctccatcgtgcaccactactaggtcttaattcatcgccagctggaggcgagaatgtactgggtccatacccacgccattcctgagcacacggtcagcaggcctcgtcatcaagccgagccggagtaatggacagttagcgggcggccccgtcacgaactctgcattgtgcacccttcagcttttattgcctcgcctacatcacagcctggctggccatgtcaccatattcgcgtaatcaatcctcccaaggtttcaagggtgcaaccatctcctcgtgcgttcttacaggccatcccctaacaaagctagtttactgcgcctgcctctattcatggcgccgggtttctctttcgttttgctcgaagcctgtccaccgcaattaaccactagcgtttcgacaccgacttggctggtggtgactcattcacactctcaccctggaaactcgtcaaaccgtgacaaacatgcctgtcggctatgacgaattctactaaaacagcagactgcgtgtcatttctctaaataccttggcccgctcatgccgcccaccagacggcgtttctctaggtagtttcgggacaaggaatcatttgcctttcgcgccttctgtttgggtgatcaacaacccaacaaaaatgcagccctcaagtgtacaccaattctgcaggcgacgcggtgaccaggatgcgccatgctcgggattttgactcgatgtctcatggcgctgcggcctttctatcagaactaacctgctttcttagcacgactcgttccattcaggacagttttcatctacccctccgtcctgtggcgcccagggtaattccaaacgagaattcggaaagggaattgtcaggtgtaagcctcgtcgagcgtggccgtcacatcctgggatgatgcgtgcccaggctctgtagggcggcccaagtgagggtctacagctctgatttaccatgtctcgaagggaagtattgtgcttcgtcaccttggcagccgactgggagcgtatgccccgtacctctgggaacctgagacacgattgccattgggtatgtgaaagggctgtccgtccatggtattgactaagtcggctcaggattgattgtcctcggactagacaccttttttatgggaccggggaatggaaccgcgtggctatagtagcacaggagctgactcggagttgctggccatgatgcagatgagtatggtgttgtaataccacattggccagcgtgcagcgataggcaatgaacatgtctaattcatatgtaggtgcccagtagattgcgtaggcatgagctgctttttcttccgcagctttgattggaatcgaaagcagaagcaccgctgtgctcccacatttcctgcgttgcatcaccgttaccatctctcgatcgtttcttgccaaccatccatgcgtgcctgaccagtgaggatccggccaaaggacgatcatagtgggtatcctctcaataccctagagtcggctgtggttgcgtcgaaccctcattccgtctcctgaaagtcaagcgagcaagtgcaactcgtatgcgtaaaaatgagaagctctagcgatctccgctagtggcgatcggaactctcaatgttgatggagtggtcaaacacacaatcagtggcagcctcttttgcgtgtgcacacccccctccactcccttccccgcattattcgaggtgacgctatgaaggctacaacggcgtcacaaaaacacccccccaccactccctcccattgagagacggcttccttatcttgtgtggtacagtcggtatagtgttttcctctgcttgataatacatgcctagccacacacatgcgtcccaacggccctagttcatcacgataatatcaagggcaaggcagatgcgggtgcagatgtagctgaagctgcagcgaaccgcgaatttgggtactccctcgcccgcaacttggcacatcacacatacaccgtcttacgaatctcgactggtgacgcttcctatgacttgagcaacccgctcacttcggttatccggataatatacgtcttgattctggagctgtgatgaccacatacccttcagcacttgtctggcgcatctcggctggaacatacacccattcctgagtgatcgaaaacttgaaattaaccaggtcagggccgactcatttcggggctgatcaacgtgacattggcgctcgacggcgagttattacacattaaagttccctgtcgccagcccgtcgcatttccaagtcgtgtctctggatccacggggactatggaggcctggaactcgaaggggcttgcggtgccgcagatatggagccagcacaatagcccggctggatttagtgctgggcgaaggaggtgcccttcccagacgcactcgtgagagactttagcccaagcttggtgagatgttgttgcactttgatgcgtcgagaaatctcatcggcaagtacatgcatgctgtaccgtgcaggactcgcctgcatgcatgcataaggtatacatatgtaaggtatggtatggatgcatgtacctcatagcgccaaatgcaacctcgggcaagagaaggcattacctagtgttgcagccttgacaattgcaactcgcaactagggcgtgggatgttattgtttcttgcattgtggctgcatggacaaagggagcaagtgaaagcgggtgcgtttgggaggccacctcgtgccagtctcctgaccagtacatgtggtcactgcaaatgaccagtgcttggcgaggtacctggcaagtccctggatgaccgagcctttagctggatctggaacagttgcctaacctacacctggcataccgccggaagcctccctcccgcccttctcgtccgccggaggatatggttaatggttgcgttgggcaccctggaggcccctgcttctcccgatgtgttgggcggttgggaggtctctgtgcagcgcacatcgccggcaacttgagacactacgagggtgcgaggcatccggtctggcagtatgtacttgggcaagctgattcgtcctgagagtggtacgtaccagccttcctggggatccactaccacccagcggcggaaggcgctggctctcacggtgcgaatgcctgcatggcgcctgctggtaggcccaagcccggcatgttggctcacgggtaggcgcagtgtgttgcgagctccaccacacacatttcaccgcttctttcgggctgcagcctccacaaccactaaccactatcaccacctcggagacacagatcaatttgccgctgagcgggagacacgacctgccgtgggccaccctcatacagctgccgcaccacgggcgcactcctcctgcctgcctagctgcccagaatgcaactactcccgccaccagccccatgatacacggggctaccagtacgtgtgcttgaacgccgccctgtttgaccagacccactggacaatacctctccccatctccccatccatcaaccaagccccagcgcgccattgagcagcagaacaatgccaaagatgatcacgaggcatttttaatcccaagtacgagctgcgttgagcccaccaaacccctcctgctgcactttgcgggtggccagcccaaccgcaaactcgaccttgcgtctcacatcccagctctggctctggcataccaagccatacagcataccgccgatgaacgtgtcgcccgcacccacggcgctgctgcatgtgttagccaattcgtgcaccctccgtggggaatcattgtcggactggtcgatctagctgcaaccgggtttcacagccagccaggtcctggctcaacttgaatgcacgtactcgataacggcaatcgccttctttggaactgggcagaggaagcactcctcctccttcttcgtagaccgagacagggcagcggctccgtcagcgccccaggtacacagggccaacgatctaagacatggcgcgactgcaagtcagaagacaagggttgtccgtaggggtctcacaatgttgaggtcttacactttcggcggtgtttcgctcctgagaaacgcttcgggggactggtatccacgaccctgatcatgatggtttagcaccctgcctgccacctttccacaaccgatcaggatttgaccgcatgctgtgttgttcaccgtacctcggcccaacttcgcgagtagaagacgacatccgcctcagccgccaactctggaaggcctggtcgtccgggcttctcaacctcgacgctgatccgcgccttgggctgtgttttgcgtacatggcgaatgcaactgagcgttgtgtctgggattcgcccctgcaaggacaaccatcagtgatcctgttctggacctttatcccttcgcgagcggcggcgtatgggcccaacggagttgtccgtcttgatcctcactggtttcctctcacctcaaagtgccaccaggtctcttggtccgcgtcaaacgcccctgccttttcctcgaattcgtcaggtgtcatttcaggtaagtcgttgtagttgatgatagtgcgactgctgctccgctcgctccggatgacatagctacttgctgcttcatcgtacgcctcccgatagagacagtgctcaaagtcgacgagtgactgttctccaaacgacccgatgacccgacgcgttgctgaggacgccctgcttgggagacatgtaatgaggtatagtctaacaggttcccgtggcacaaggatctgctggagcacctcgagcgagtttgggcagttgcctccacgacggatggataggctggtcgcacggagctttgagtcttcttccgggaagaacggtacactagccggacgtaagtcagtagtctcacatcgtagacacggttcactcgttggcttccctgagaatggtatctaagtaacacgcccctacaagtattaggtgctccatgattcagaaatgtgttccaaagccaaaattcgacctgtttgagatgcgtcgtcacaatagtctcgctcaggcgcgatcaccaccaggagcgtgcgtgtggtcggatcgccacggcgaaaatgaggactctgcaaggaggagttatgcaatgtgccgggccatggttttgccgcgttgctgcattctttctccgatcatagcgtgggcggctcgaagcacaactcaatgctcgggctattcgcgagaaatcaaattccactacctacgtggtctaactcagattcgtttatagtgtttttcttttgtatctggatcgagtctaattgcccattcccctgccctgcagcggcgtcaaaaaaaaaagcatagatggtccgcaaactcctgatttgataggtaaactaacaactactattcgtgtgaaaaacgtcgatatatattcccttgtgtatgtatgtatgtatgtatgcgaccggaggatttttcagtgctcccactccttgaagctcttctgcttctgcctcgtgttccagcccagcttgccgctgatgctgtttatccagtcctcgctgcggcggccctcggcctgtacggtggcgaaggggtagcggctggcgctgatggtgacgtagtcgcccggcttgagctcgacgcgctcgcggccgtcgaagctggcccagctggaggtgcgggcgtcgtaggggacgccgacgcgcaggacgatggtgtccgggaggatgatggggcggaaggagagggtgtgggcgcagatggaggtgacgagcatcacggggttctcggggtggcagagcgagccccccgcggcgaggttgtaggccgtcgagccggtcggggtcgacacgcagatgccgtcggcgaggatggaggtgaagtgctcgtcgtcgccgaagagctccgtgtacgacatggctggagggggttggctgttagttgactcgtgggcatggaagggcaccgtcctggggtatttggcaagcttagcatgcagctacagtttgacttacttgggtttggccctcgatcgacaacgatctcgttgaggatctcgtaggtcccgtcggggcggtgggttcgcgcatcttccttctcctcgccaatgagctcctctaccaagtcccgtgtgtgattctcgtcctcgtcgtcctcgtcggatgcacccgaccggatggctctggctgaacgtcgtttgcttctcatcactgtgccttcgaaccgtaatctgaggctcacagtgacgcccttgctgaaggctgactccaacgtaggtgcgaaatcatcaaagtcgaacttggtgaggaagcccaggctcccgagtgcgaagctgagaaccggaggtactatcctctggaatagccagctcgcgtacagtacggtgccgtcgccgccgagggtgatgacaaagtcgaacatttggggccgtgacctgcacatctcctcatcccagtacttgagccgcctctttatatccagcagggctcgctcgtactcctcctcgccggggttgccgtaggtcttggccgcctcatcgacgaggccggccacgtcgaacttcttgttggtccgcagcgtgtcctggacgtagacggtgtaccgcacgtcgcggcacttgtccaggagccagagcgtcacctcccgggtcttggggatgaggtcctggtcgtagacttttgtcaggaggaagacggacttgacgcggaagcggatgcgcatgctgctcagccgcctgctgagctcgcgcacgccccaggccatgtcgctgagctgcttcttggtgagggtgcggctgtggacgtcctcgtactgcgtcaggtccagctccgagaggctcttggtcatctcccgcgtccacgcctgctggtccgcctggccattgacgtccttctccaggctctttagctcgacaatcgctcgcgacttggggttcctggccccgtggtggcccagcccgtccatgccgggaggatggaacgcatgatgatggttatcgccggcgggcgtcgtgctgttgtcgctggggctccccggggagaggcattggtcggagccggcgtcgctgctgccagcacctttgtttgcggcgcgcctctggctctcgaggaactggtggacgatgcactcgtcgcggcgcaccggtcgtggcggcagtgcaggtttcctgatctccgacgagaccatggagctcttccgccggaaggagctcgaggggtcaaaggtcacctgcgtttggcggctctggtcagcgacaacaagcacgctctgctgggtgcgactggatccggccaacgtacctcgacactggggcactcatcgtcgctggctccagggtcgtcgtcgtcgaatacaacgtgtttgtttacgctctcgggcatgatggtggggtggcagatgacgtttcggatgaggaggggctgatctgatcctgtcgtggggtatgtctacgaccagtccggcagtgtgctatggctcgttgtggtgagaggagagaagcccgggacaaggaacgtcataggagggactggagactggacacacgcgaggctttcgcggtaaagtgcgaacggtgctgggtcatgacaaatggcgttttcgaaacgaatgccggcggcacgattacatgaatcttacgaggactttaacaaagcaacagattgacttttggtaagggctgaagaagcatcgaaatgtggttacggctgaagtaccgatgaagtaccacaaggctgtctcgataggataaatgtggcagtcacatcaaaatgcttcttttatgcaatgataaataaatgcaatgataaataaatgcaatgataaataattccatctaaaaattagtcaattatcagtcaatatatcatatcactgtctatccatgttgtggcctgtattagaggttgagatacgaaaacacctttgcagtccctaccttaggtaaggtattatcagacactcacttaacgatttagctttatgacgctggtagagagctacaccggccaaattcaacttcaacactattgccatttagaagtaaagcacagcattcttagtacagccttatctacatgatatatcgaatagcaaaaacacctccttaatgctatctacatacaaatctcagtgcacctctatttcacccttcaatgatacaccgagaagcaccctctccacatgcgattgtgattagacaccgccaaattgaaactaccagaatgaacgatatggaccacctgccccagagagcattcgcccgactctcgctcgctgaacctatcccatcagtaaatcccacaatgcgtcctgctccacgaagtcgtggtgtatgatattcacgagccaacaatcatccttgattccgttcagtagcttctcgctctctgatcctcggctgtacactctggcccattctccccagattccaaacgcttcctcgctccatgctcggaaactgacctcctcgatgatggtgggcgtaacaatttctttgcctgggaacacaccccaggtgaccgcgttcgtgtcggacgaggcggcgctgccactgctggcaaaggtgctcaagtttgaagaaacaaagtcacccttggcgttcaaggcataaaagcatatggtcccctctgcggcaggtgccttgagcttctccaagagaacagaccagtctgaggaagaaaggaagaattcaacgaatgccttctggaacacgaatccgttcgccggaccccatccaaaggttgagtcggatgagcgcagtccgttgacggcaggctgagaagccaccgtccaccagcccttggtgttgagcttcatgaggtggttgctgatgattgaactctctgcgagtagttcctcttcgctccaggggatagcagctaattctcctttgatatgtttaacaaaaagatcattgatctcctcccgagatttggggtggccccagagtctgatggcttgggtgggggtcatgtgaatgctcacaccgtagccatcgatttcgccatacgcgggtgatcgagaatcaccaaaacgaccgttgggaaagtcatcccatgtagcctctcgtcccaagacgccctcaccctccgagatggccaaggtgttggagcgggtattcggggtttctgcactgaggccagcttcctgccctgacgcctcccattcaggatttgagagttggccatctttgacgatgactctgttgtgtggatcagaggccaccgaagacgacttacgccttgaaaaccgggagcgaatctttcctgcaggatcgccattgatctggagtgtgatagggggcccatcgacgattgcttcttcttcatctggaatcttggggatcagatgagtcctctctacaatgaacgagacagccttctcgagattcaacgtgtaaaagtgaaaacccttgggaccgggggtcttgttcttgacgactttgatcttctccaccagttcactgacaatatcgacaccgatcgctttgactttctcatcatctcctttgacggcatctagacgtgagtgtatatcctcgggtaccttggcgtgactcaatttggtcgtccgtttaatcatctgatagctctggatgggcatgagacctggtaggatgggtatcgttttgaagacaccgctggggtgctctctgagtgtattctcgaagttttcgtaggcttggaaatcaaaaaacaactgagtcatgatgaaatcggcaccggctgccaccttgtcaacgagatatgggaggtcatgctcgagactctgtccaagcgggtgactctcatcggcatggccttccgggtatgcagcaaccccgatgcagaaatagtcgccgtgcttcttgcggatatatttgacaaggtccagtgcccaaacgagctcttcagcatcgtcgtcaacctggtcatcgggcatctggtattcgtcctttcgcggcgggtctcctctcaaggcaaggatatttcgaattcccagcttctttgcatcctccagcgccttatcaacaagacggcgactcatgttggtgcatgtgagatgtaaacatgtagttacaccgagttctttctggcaccattcggcgagttcgatcgacttctcggcggttgatccgccagcgccccaagtgacgttgacgaacaagggtcttaatgctctctccatacggtgaagtcggtcttttaaattgctgaaacccatttctgtctttggcgggaagaattccaaagagaaataggagccatcggccggcagagcggcgatcttgtctgtaatcttctccatggcggactggtgtgtaaggtgttggcgagaccagttattcggctagtatcgggaggcgaggtaggaggaggaatagggaggaactaagtcggatgtcgatgataacgaaatagtattcactagagcagggcggccgttggaaggtgatacccgaataccaaagcacgctgctactccgggcgcaattggatcgaaccggacaagagctggcccaattagagggattagaggagcacagcctgagccgcttgtggaagcagacttggtatgattcaggctcgaagagggacagacccagaacacccactgcgaacggagcgatgtctgagttttgtttgatggaggggcaattctggaggtaccaattaagtcataaggtaggcatggtggggtccggtgccggctctttttggcctgtttctgtacacccaggacatggttcgaccacacgatcaagcagcttccaggagctttaactatcgagacgcaacatgttagcggcggatcccaagtcctcctttgcgaacttctcctcatcaacagagcgccctagccacgggagcccagatccgtcgtccagcagcgctccccgaaactcggaattcggagccaacttgccttacccttgcagcccaccgcgttagcattaaccgcacgccaaacgcatgccgacagattaccgttacagtgggtagctccccctgtaacagatcaccgcgctcggactcttaacgagcaacatcgtgccatgcagctctgatttttttcgcgacgcttttacttcccttctaccctccctccttgccggcggtagcaacatgataacgccccaatgcatcccctccgtggaaggcagctagtctgcggcgcactcagagtgcgctccgtgcaccctttattcagatcaatcccgaaaaccaatcctcgacaggccccaaacagcctcgcatcccgacgatggtacgcttcgctcgacctacccgccctcgacaagaaatggcgtcagagatggaatgaggcccagaatgatggcccggttgccaatacatcatccatcgccgacccagacaccgaatatgtactgcccatgttcccatacccatccggtacactgcatctgggccatttccgagtgtacaccatcaccgacgttgtcgcccgataccgcatgctgaagggtgacaaagtcttcctgcccatgggctgggatgcctttgggctgccggccgaaaatgcggccatggaaagaggaattgctcccaatgtctggaccgagagcaacattgccaaaatgaaggagcaactcgagcaaatgaacggaagctggacctgggacagagtatgtggagaatactcttcaattaacttcggaaaatagcctgacgctcgatctcgtaggaattgacgacttccgaccccgaattctacaaacacacacagaagctgttcctcatgctccacgaacgaggacttgcatatcagactgaggctgaagtaaactatgatccggtcgataagacggtgctggcaaatgaacaggtagattccaacggcctgtcttggcgatctggagccaaggtagagaaacggaaattaacacagtggtttttcaaaatttccgaatttcgggaagcattgctcaaggacctggacacacttgctgcaggcgaggcatggccggaacgtgtcctggtgcagcagaagaattggctgggaaagtccaagggcgcactgatcaaattccccgtcatggccattggccatgacatcaagtctgccatcgaagtatttacaacgaggccagatactctcttcggcgcgcagtacattgcactcgcctcttcgcaccctatcgtggagcaactggcgaaagcggaccccgaactatgcgcctttcttgacacgatcccaggactccctgcggactctaaagttggataccttttaccaggcctgcgggcggtgaacccacttgcatatcatgaggatacaccctctgcgaccaaggcatcgatgccaatctatgtcgccccatatgttctaggagactacggagaaggggctgtcatgggtgtacctggccatgacgttcgagataatgccttctggaaacatcatcactttgaccagcccgtgcgaatggtacttgcggcatcagaggatgaatcgaccgaactccttttcaacgagccattcgtaacacacggagtgatgaccgaacacagcgggcccttccgtggaaaatcctccgtggaggcaggcgagatgatggttaagatgctggagcaagctaacctagctgaagctgtcgagaaatggagactacgggattggctgatcagccgtcaaaggtactggggcacgccgatccccattattcactgtgattcctgcggtgcagttccagttcctgaagaggacctaccggtgaggctgcccgaggtggatgaccactgggcagatgggaagacgggcaatgcgctggacgcttcgccagactttgtcaataccacatgccccaagtgccaaggcgcggcgcgacgggacaccgacacgatggatacttttgtcgattctagctggtattatgcacgctacgcagatccgcataacgccaaggaattgttctcaccagaggctgggagaacgctccccatacacacctacctgggtggcatcgagcatgccatcctgcatttgctctatgcgcggtttatattcaagtttttggcaacaacaccaatgctgccccaattctccgaggaggccggcgcggttgcggagccattccagagactgatcactcagggcatggtccatggcaagacatacgtcgatcccagcaatgggaagttcctcaagccgtctgaagtagacctctccgacccccagaacccaaaggtcgctgctaccggagagctggcgacagtgagtttcgagaaaatgtccaaatccaagtacaatggggttgatcctacggagtttatagccaagtacggagccgactcagcgcgcgcgcacatgctgttccaggcacctgttggggatgttctcaactgggatgggaacaagattgtaggcgtgaccaggtggttgcagagagtacatgactatatctccaaggtagcagagacaaccgcccctgaacaggacagcacagtggttgagtatctctcggagaggcatgcaaagcttgatagcatgagcaaaaccgagcttgccgagtgggatgcggataccgcggtatggcgagcagtgcagtacacgatcggatcggctacaaagtcttttgaggaaatctactcgctgaacacagtcgtatccgatctcatgactctgacaaatacactgggccaccacaaggaggcaacgggcgtggtcaagcgggcggcgtcaagtgttctcgttcgtatacttgccccgatcgcgccagcctttgctgaggagtgttggagtgtgttgcaccccgaatctggtaccagcgttttcgctcgcggcatcttccccatccaggacgagagcagccacttgttgcagccacgaaaacagccgtgcgctgtgcaggttaatggcaaagtgaggggagtagtagagatctcccctccccccgagggcctcgagaaggaagccctacagaaatggatggttgacgcgatcctggagaccaaagagggccaagcccggtttggcgaggagtcgtcatacaaccttcggcttgcgaagagggcgatcgcggtgaggggtgggaagacgatcaactttgtgttgtagcaatgatgtactatatgcagggagcacaggagttggatgcccgcaaggccagcgcacatgaaaaggatgagagggcggtggcgcccaatgatgatgaatgtatactagaattctactgttcactgtacccggatagattcatacacgaagcagatgatttgacttttggcgctcatcgaaagggggccggggggaaaggaggaaacgaataagagctatcggtgcgagtctgaggccggtttggtgggatcagaggagatagcctccgaaataaagaagcaatcaagcagatcaaaccgaacgaaaaggcgtaagaaggtgtgagggctggcacactgacttacaatgctttgaccttttgaacgcccagtcgcagccaaaaccaatatttcgatgtcagcaactattcgggaaggcggggttggggagatcacgaagccacgagccaaggtaagccggacaaaatcttgttatgcacatcatctttacagatcctggatatcgtacatcgggcggcatggaacggacggcgatggatcaacttgctgtctgagaggaggtccgcgcgtgttggtggtctagacgcggccgctgctggaaaccaagcgcaatggcggcacattgggcccctcttcggggattgtgtgtaagccggcactggccagcggggttaagtcatcatcttgtcaggaaatctccgggatggaatattcctcggtgggctccagaagaacgcgctgggcgcaggctgcgctcctcaggacgactgtcacggcctctcggcttcgttctggaggcaggcgagcgtgtgatgatgggcagcccatcagacggttcagaccaccatgtggttccatccgcggcctgtttcttcttagtgacatgggtcggccgacggatggattcgatcactcatttcccccccaacaagccccatcgcccatccgcatggcattggcggccgatggctttttcctgggcctagctctagcgggtgagcagtctgctattgatggctttagaggcccagcagcccaggaaagatggctgccagcgtggctgccagaccgagcagacgatgtcaggtctcttgggcggactccggtgggctcctcctcctcctccttctctctctgcatccatcatccccaatcctgttttaaaggcctgtcgctgcgctctttcgcccaggccctacccttcgtttgcctgtgggcttgcttccggttggatcggttttttcccttctctcccagcaggtgatgtgatggtgtgtcggtgccaatacgactttgctcatcatttgcatcattcttgaccgctgccagtcaaccagagacaaggagcgactcgcagccagtgtccctcgcttcccctcctcgcctcgtgtccgcaggcatctgggtattcgcgtccgcctcgtccttcccggtgcacccgcaagcgcatcaagtagaacaagtcgaaaatcccctcgcagcgacctcacccaagaccgaggggtcattccaaccaatcaaccaggctcgttgcccagtccaaacccacgacaatgtctcaaccatactcagagccgacgtcaccaaggccagcgccagcgccagcggccaagaagacgacgacgccggcgtcgaccatcccatggctctaccggctcccgctgctctacatcgagcccctgtgcgcgctcaacggcgcatacctgctctacctcaagccccgcaacttcctcgaggtcgtcacaccctaccatgagaagcacttccccaccgccgtatcgtcgtcgtccgtcgtcgccaacgcatccaagatcctcaaggcggcgacgtcctcctccaaggcggcgccacccgtgccgaccctgtcctccgtccgcgtcctgaccgacatgctggcgggcatgaacctcctcttcgccttcaacctcgccgttaccctccgcgtggccggcaacgaccacaggctgtggcggtgcatctgctcgggcatgctcctctccgacgccatgcacgtctacgcgaccgtgagggagtttggctggcccgccgtgctcgactacaactcgtggcggaccattgactggctcaactttggcatcatgggctgcatgaccgtcgtccggctgggcgtcgtcgccggcatcgggctcggcaagaagggtggcagcaccaagaagagcaccgtcagcaagagcaccacgaccaccacccgccgcgcccgccgcagcagcaccagcagcaccatcaccgctgtcagtgaagcacctagcgaaccacccagcgagaagaacgctgctgccgctgctgttgccggtcccagtagtaccacaaagaaggccaagactgccaaggccggaaagaagacctctggtcgcgcaaagaaggctgaatcggtgaccgggaagcaatagccaggaacacaggcctggtctgggtcccgcttctccgtgggacggtgatgcccgttatgaactttttatcgttgagtttttttagttatcaaaataaggttgtatgtacatagccaaaaaaaattaaaagaaacttttgctgaaacgggccaaagattgtactcttctttctcttttcctacctattttctaggtagtctgtcttggtcagactcgagacttgtaggtacgaatgtgctttgtacctttatgcgatcattacgaaatatgcagtcatatctctccaatgcacccagaggcggaattgggatgcgtgattggctgactcgtttgcagccaccaaataatcaccatgttcttggcggccacggagtgttactatctagctattagaaaacattacagttctactctagattctatcccttctcatcgccatctcagtctatccttctctcgtcggcttcctcgcccagcagccggcgctcctcgtcctcggtggcattcgccggccgctctgggtagagcacgtagtgctgccagatgaagacgccgtcgtacgccatgctcgcgttgccgagcacgaacttgaccgggttgcccgtgatgccgctccagtcgtgctggaggtagctgtcgatcccctgctgggcgacgctcaggacgccgccgagcacgtccaggaggatctgccagatgctccacccctttgtgctcttgttgcggtagttggcgaccatctgcggggtgtacttgacgagggtgacgacgaccttgacgtagccgacggcgtagacgacgtcgagctcgcaccagtcgacggccgggtcgccggtgcccggggagaggagggcgacgaggatggtgaacacgaccccggccacgcagccggcgctgatgcccaggatgggccggctagggctggcgccgcggctgggggcgaacccccatagcgaccgggcgaagaagtactgcgaggtgacgatgaggctgaggacgaggccgtggagggcgaagacgatgtcgttgaactggacggtcggggtcaggccgccgtggcgggcggcgtactgcgctcggacgacgggggagtaatagaagacggcgttggaggcaaagtacgccgtgaagcctgtgcggtcgcgcgacgaggagtcatagcttgtcagtcttgtttttcctccgttttttggagctccgttcagatatgatatgatggcatgatggtggggatttgggcttccgggtcgggaacaaacaggtattgagggacaggctcggggaagttacgggaaaagccgcgaccgctcaaagcacaggcacagaacagaaataaatgaagagaataacaggatatgaattatttatggagaagggacagggggactttcggggatgtgaggcgcgtaccgaagcagttgaggaacggaaaggcgacggtggtgccggaggtagaccggcggcgccagttgagcagcgcttgcgggtagaaagaggcggaccaggcgacgaagtagatccagccaaaggcggcggagacgaagggaagaaagccaccggccatagtgggtggctacaggaagccggtgttctcgagacacggaggaggacgaggacggagaggaagagaagtgcctcagacaggggagagaacccggaggtaggaggaagcaactggaagggtggagaaaacgcgcgtgatcctgctggcgatgcgatgcgaaacgtagcaagcgactacatcacctgcgcggcaagagaatgaccatgtacctaccgatggatgatgtgtgggaaggctgggacgaggtggggatgcgtcacgttgcccgcgataaaaaggcggcgattgcgagtttcacgagataatcacctaatcttaccgatccaaggtcaagagaggcctaagcgccggccattgcaccgctggagttgaggctggcagtgcggcagaggcggcgatagagcgtaggcgataatcgataatcgctaatcgatagcaaccaccttcttgctgcaggtaatcaattaatttggtcgagcatcaccatctgtcgagtccaccggcggggccgtcgaagcttctaaagtgacattcgctctcgggtcgggactggcctggactggacaaggatctcgccgtctgcgatgcgctgccacagcgacaccattcgatgcgatgcgatacgacctgccggtgcattcagctagccacgggcttcgttcggcatctcgacaaaggctgtgcccaccacggccattcggcggtgcctccgtgtccgcgactgactgggcggctgcagggcgcatcacgaaccgaaccaccagaccagggttgccgatcaagccagattcgcgtgtacatgacaccctcgtcccccctgcttcgggtcgaattaagcgagacgatggcatgagatggtggcgtgggtggacgggatgtgatgcgatgggtgccaataagccagaccatcaacggtaacgacaaatcaacatcgcccacaaccaccatcaccatcaccatcacagcagcagaggctggctgaaaagtaacgctgacgggatccgtttttcgcaagctcaatagttgatcagcttcccggtaggctcaggctcaggctcaggctcagaaaaaaatagcagcccaaaacatgattcccggttctttttctactcttgaatttaatcacaccaccaacgagcctgcccatggatctgactgcacggacactcagatggacggactgggccgtcaccgcctcctgattgagcctcagcaggctttctgcacacccccccttgaaatgcctgcctccatcaggcctatttcggtgcatgccagtgccagtgtgtttgatagacttgcagtttcgggtcctgtcatatgccgggaataatccccttccggttcatcccacccagtcgggccccttcagctaggttcatccatgcgtcgcatcaacgaccacccttatctcaccatgatggtctgactcgccgtcatctaactattcttcttctcaggcacaccgacccaaaccttgtctttcaaagggggtggaggggggggcgtgcgatgactcttctatgcgacgccaatgcgataccatgccggaccgtaaccgcaccatcatcccatgccgataccataccatatcgatgtgctggtcgataagcatggactctcagatgtttgattggaaaattctcatcacgaaatcacccgatatcttacattcgaggatataaatattcaatgcgcccatgcctcaggggctggcattgcctttgtgttttgaataccatagcaaatacattatacacaccatcagtctacctgctagctctgactaacaattcatcatatcccttgcctcttcgccatacttggttataccggactggcatacatactcacgcctacaaatcacatctacttacgcctacacatacacacacacaccatggagacgagtaataccaccgacctgatgtcgtcaccaccaatgtcgtcactggcttcgccttcatccgagccacctgctggcctccttaccgttcctctggagatccgtctccaaatctactcctacctcctcgaggtcccagagttctccccatacactctcccctcgaaaaaggctcccgtagccggtgctctcctacggaccaaccgccagatcaattgggaggccacgcccttcctgtacgcccacaacacctttgttgcccacccttctctcctcgccacattcccgcgcctgcgtcccaacctcaggcccgtctcggatccctacgccatttctctcatccaccgttttcacctcacggtgcacctggacagcgatctgccttatgaagccaaggctctcaccgagtccttcaccggcgccgaggagctgactctccacctcgtccagtttggcttttgcggcgtcggctatgcgaacctccgtcaattcgagggaatccgcggcgtcaagcgtgttgtcatcgagggcagcacgacagggttcgaggactacatcgagtggcttcgaaaatccatgatgagcgagccggatgcgccgattgaggagttcaagcacgagcacgtaactctggtagatcgcctggcacgcggttacttggcctaatcttcttcgccaagtcttcttctctcttccaccgccacacctgttggaggtcatggctcccttcgtcttccttcttcgcttctttgtttttttcaatttggatcaaaagggttttttctaatgtctataaacggggatcagcttggatcctagaaacgtcttacatgcatatttggttttgggcgagcgttgtgatattacaaccggagtgcagagcacccgagaaaaaaaaagttggatagaatgttttgattcccagcgcggccaaaacaaccacgcatgcattttccgggcaagatatttgaggcactcttgttttttcttctttcttcttttagtttagagaaataaactacacacaacaatgaaagagtaatgaataaacttgcaatctacttttcagctcatcaaactcgacactattacatggccccctaactaattcaacagaggctccttgttgccgtcaccgttgggcgggtttgctcggcccgaggccggctctgtcggtggaggagatgcgaccaaagaagcgacaaactcgggcggcagtggggggaacaagagcgggctggttccatatattaaggaaatcagcccaacccacctcgcctcaatcacctcactgctacgacgtgcattcttcacgcactcgctcgcctgatggacgagtggtctggacgacagctgacacaaatatcacagggacgacgggcccacatgaagaaacggaacaaaaatggtaagaaacataataaatgacaaaaataaggcaagttaccaacgccgtctctgatgcagctcaagctcagatacatcatcagaccaccaatgctatatgtccttctagggatacatctcaccttcctctgtctttgtctttatctcccctttcctctccccgccccgcaatttgaaacctcgtctaaggcgccaaccgaccgaccaaaccatctagatacccaggcgggggctaagagaccaaaggggggtctattaacgttaggataacaaaaggaaatggtagcttttttgtgttttactccccaccgcttcacgatgcctcgcaggactcacagagaccccggggcgtggtggaggacaggtgttggggatcccaaccgggcttattgaccgccaccgcccatgattcggggcagcgtccgccatccctgctcgttggggagcttgggacggccaaagtcctggtcgaggtccaggatgaccttgagagcgttgcgggtacgagcgaacgggctggtgtccagggcgcccttgatgtgtgccacggcgccagcaacgccgccctgggcggggaggtcggccttctggctgccaggcatggggaggagagtttggaggacttcgtaggcggccagggtgaaaccgaactggggcgacgatcggaagatacgggcagggccacccttgaagaaggctgtgaagccctcctccttccagatggtcttggcggcgtgtcgcagaccgttgtactgggcatcacccttgcgggcctcgacctgcagacgggtcttgataacgtcgaaaggtgtcgtcaggtaggcggcgggcataccagcgatggcaccggcagtcaggagctgcaggacacccagcttgtgggttgccgactcaccgaagaagtccctcttcaggtggctgtaggtggggaagtagatggccgagaagggcacatcacggagaagacaggcggaagcacccttgtacaggcccatgagacccaggttgcggacaatccacatggcagatcgcttgggcgccgcgctgccggatttagcaacctcaccctggacttggagacgaatcttgacgatctcgagggggttcgtgaaaacctggagagaggagcaaggttagcttgggcgcgatatttgaattccactgcgcttgatgcaaggcgaagccaagatccgagtgggaaaagggagatccgattgggaaaagggagaaacttacgacttggcaaccaccggcggtaccaccagaaataacttcactgaaccagtggatggagccatccttcttggtgaagaagttacgggccaggtcattgacggtcagcttgatggccttctcgggggcgacaccaacaagctggggcaagacaccagagtacaggcctcggacaccctcgttgcggacgaccttctggaagcagtcgatggagttcttgtacagcctctgtccgggctgcgcgccacgctggttctggagacgggtcttgacgagatcgatggggtacaccatgaaggcaccgaaagcaccggctatacttcccaggccaaagttgtatgccgaggtcaggatgctgtacaggactgagccctgcctgacggtgggcttgagggcagcgatgtcaatgtcgtaaatggggttgcgccacgacgggtccaggacctttgcgaagtcgctgagacccaggcggccggtctggttatccaggccagcgaagtggaagaggatgtcggcctccatgggggtgaagagggagaagcgggtgatcttggcggcctcgttgaggaactcggaccgcgtgatcttaccatcggtggtgctcttgcccacggcgcggcggacaatcagctctaccaggtccatctccttgatcatgttctggaacgcgcgcacgttggcgtacgagatcttggagctgacggagatgttgcacagggtctggaggttctcgagcaagtggtcggagagcttgtgcttggcggtctccaggatgatcttctggaagtcctcgggatcaatgtagccatcgccgtccttgtcgagcagctggaaggcttgccggatgcgctctccctgcaggccgcgcagcatctgggagaactgagggtagtcgagggtgtgcctcttgctgccgctgccaatgtacagcttggcccactccgagtcccagtcaaaggggatgttgtcggcgcctctgttgagctcgtagagctttcggaagtcctcgtacttgacatggccggtgcggtcgacgtcgaagagtcggaaggcaatctcgtactcagagtcgggcttgctgagcaggttctcgaaaacgccccagtcggcgagggtgacacggcccgagttcttcctgtcggctacgcgaaacaggatcgaatactgttcacgctgaatcttgtgctgtcgttccgcgacatcaattgcatcgtaagcttccaaacgtctcgtagatgcccgcgcgcatgcggagcaaagcataaatcccccgctagggagggcacggggaaacttacgtagtcctcgccggagggaacaacggcgtttgtgaactcatcgggacccaggtacagctctcccgtcgcaggatccttgatggcattggccgtgaatcgggccttggtctgcgcagaaacctggacaggctcctcggagcccacgaggccctctttgaccgcttccttcaccttgtcgatctgcgccattttggcaatttatctggaggaaaggcaagagaggttccttgcgatcaattcaatcggaaagttatcttggtcttgtgaccgaaaggttggcggatccagggacaatatgtctgacaaacgtgtccgccaagaccaggttgagggttggatccgtcgatcggaactacttcgctatctccacgcacggggaaaaaaaagtcgcacgccgtgggatggaggtcgtatgcgcaatttctattaacaagctcccggtttattttaagaagaaaagaaaaagaaaaatcgatccgaggggaagaagagacgattaaggaaccagattgaggaagctaccgtcaaacagtcaagcttcgaaggtccaattcccccagattttcgaattctagaaagctcgaggcgtgtcggaaaacgcacgggattctcccaactcaaatattagtagtagatcaccaaggggctatgcgcaggtagtggtagcgcagcgtcacgcgccgggggggggggataatcttcgagttcggtcaagggggtgtcccagcggttgagcggaattgacggaacaacgttttccctcaagcagcttgcacgctttgagggtgtttaggagaaccggaagagcgcaagtactgaagcggttcgccgtgttccccgagtcccacgtgtcgcatgaaaatccagattccaatctatataagatgcggaccctagatgctgcagaaggcgtcttaaaaagcaagtcagacccgatttgcgctgttaccaggtctccaacccccacgaccggaccggggctgcagaagaggcagtcgctgcaagggcttgcagcgacctctcccgccccaagaccggcagctaagagcagctgagcaggtgaatctgagcgcacgcggcgggtttacccgaacgtcgttatgcctgtggtacagctgctacaggcgaccgctactgctaacctgccgtgcccgcccgtggagctattgatgggcctgctacgggcctgtgacacagcgttcagcagcaccgcaccgcaatcggccagcagcatcctaccccaaaactgggtcggcggattcccgggtctagttcgggattggtccgctactgctgcagcccacacaatttcaacggagactggtttccagcaaaatcaaacccccccgaaacgaggctcgctcacgggaaaacggagattgattgttggccaaagccgctaaagactggatgctgcggctccataccgtatcgcagctagcgtctatccaccaaaaccatcacgagacttccccatatccccagaacagagcacacaaggagagaaaaaactcctgctcgccggagctatccccgcacggcacgaaagctcagactgaccctcagctaccttgagtgaggcacttccaggactaccgaatccacaacttgtttgctgtcacgcaggtccccgcaaatgaaccagtaaatgaagtttttctattaaagctaaggtaactgcaattccctgacgccacctttgaatcatgccatttgaaggtctattagagacagaacagatgcaaaatcccatcatacgatgggcgaaattattgatttcgagtcatacacgtttatggtccaaagcagggttcaaaagcacacgtagatctcagggttctcccactctcgatctgtacctgccgatcccgccaatgtgacgtccaaaattcccccagtaaagtcggttgcttttggcaagggcaataatgtctagattaatagatcccaacgccgccccctggtataagcaaacagcaaagcctatggtgcataaaacagaaaaaaagtcttagtagtacgagatggatgcgatgtgatcataaactcataaggtcattccaaccataaacaagctgtgatgtgtgttgtggttggtgggcaaatttcgggctggccaggatacttgggaagccagtattaaagtggtgtgaataatcagcttcaaatgcaagggttgggaaacgttatcgcctcataattcccaacccttcccattcgcaagtaagcataccggaacccgattcttcaacaggcgttggtgaaataagagaggctcaaaggagaaggaggagcagcgcgcgcgattgttggcctcgagagcaagtcccgaacaatccaagctagccagaaaaggagcgctggcttagtcaatttctcatgtgcctcatgtttcaataggaacgaggtgtccttggtggtacaactgatccgagacatcatccaggcaaggagcctgtgaaggtagcatgcggagtgacgacgtgtactgcgataaggcgaatccttgttcaagggcatcctgaacgatcagcgaggcctccttgaacctcttgtcgcagtacttctcatagacggccccgtggtgtagtcgtggctgctcgcagcaaccaatcatcatgctcacgagaggtctgagctggctccaggtgtaacccgagtagtggacatggtgcttggtctggatacttgttagcttactatctctctgtctgaggatccaaagatccagtgaagaatgcgtacccattcccccttctgcaaaataagtcgtgagaggcaatgcgctcctgcagccaggtagcttgggggcgatgcgacgaaacgctcgtccataatggtcagctccaggaagtacttggccagggtgcgggtctcgagatcgtaatcgtcagccttgctgacacgtctcaagaagctcattggcccaggccagccaagctcgaactgaagcatactaagcatgaagcgctctgccttcaaaatttcctcggcggtgtagccattatcaaccatatagacaatctcttgaagtgacgggcagttgatctcctcgtacttggaagccacgaggatggcagtagcgcctacgagttggagctttccgatggacacaatcttttgagacaagaaccgatcgatatagttcaccgtgaggaagagtgtctctgggaggaggctgaatcggctgtggacttgaaccaaccaatccataaggaccgagcgcattgaccattggatctccgtctggatatccatgtaatgcgggttgggaagcatcttgacctgtggagaccgccacgtcagtaaaggttatgcaaaaggaaactactatgtcttgacccacctcaagttctcgcatgtattcaaagatctcttcaccgtattcagcaaccatgctaacgtcccaggcttcttcttcaatatcttcgggctggcgggtttgctccacctcgattcttgcctcctccagttcacgttgaattcggagggacactttgggctggagcaacgttgtagggccgccagttgtcatgtcccgcgagcggaaggagtgggctgtggtgtatgcctggtcttgatcatcatagtcttcatcatcctcatcccaatactcctctggctccgagagccctggcgcggttccatctgcgtagttggcaggcacgactccagattcctcagatatctcgggcagccgagaaggcatctcgaggtggttttcgacctgcacagattggcttgcagcctccaccgagacaggaccagccccgtcactgtcagtctgggtttctggagatgatgtgactagtgactcagtggctacactctggcttgttgattcgagaatagtctccgtcctctccagctgtcggctctgggtccgacggagcgttggtggccgttgtttgagttgaggctggctcttatgatggcgcggttgagggcgagtttcaagcgagctcttctgcgatcctcggcgctcatgtgacgcacggttggtgttctgcatcttgagtgcctcccgggtctcaacatatgtggcaaccgcgttctcacgaggagcagcctgttccagtttcttattgggctcgttcgctcggttctcaaggccgcgctttgccttgttggcaacagcaacggttctctgggctggacgcgcaagaccatccttcgacacaagtacgttctccttgttcacgggtcgcgtggcatggttaaattgtccaacagattttaccttgacaacctttgcgtcttcccgtttcgtgccaaccgcctttgtcaggttagtcacgtcgccaaaggctgcacgctttgcctgcccgcggaaaccggccgttgacgcgtgagagttcgcgatattcccggtcgagttgtgtcgctgatggatggcattctcggtcccccgagggcgaaaaggctggagagcccaggacggttagcatgagcacagaaagagccggatacacgtcgaaaagcatccaaatcaacgcgtcaacatgggtgctggggcttctgcttactctggggtccatggctgggtaggagaatctgataattggggatactggtcgccctgcgcgcgtcgcgatggactacccacgacaggtagttaccttcggtcgggctttcgatacaaaaatcgtacgcgagttggatgatactaaattggggcttcgctgggcgtggtggtgagggtattcgataattgttgggtttgggtggttgggagctctctcagggagggcaatggggagaattgaattgacgcggaaaggcgagaatgatggccctgggaaggctcgatgaagttgaacagaagaaggacagaccgttggacccggaaagtgatacaaccaatgaagtaggcgaactcgctaagaagtggcctaaaaactggtcgccagtgaggtatgtggtgatgtcggcactataaaggcgctgcagaagaagcgaacgaaaaataaatgacgaaaatcaagataaagtttgggggcagagggaagggaagaacgcaatgtgacggctgcagactcttgccagtcgttgttgtgctgtgcaaagaccagctaaaagctcctgagctggctatttcattactcgcaattccaatttaaaatgactgactgaggcccatgtttgtttgtttatgtctctgccgtccagcattaaacgctttcacaagatgggattggctggcagccgccgatgcataaaacgggcatgtagcgcacagaccacctgaagatcactgcgcatcaactctccgtcgtcacagcgatgacgggatttctggggtcgcatcagcacctcaaggcccatctctcggcgcagggtggttccttagttatcaggttcgcacctattttgggctcaaattagttggtgacctcttgccatgaatgcgccatccgtgtccgccgcaaaccaactgctctttctttgttcctacccgcgttgcgctatatctcaacggacgggcggttgcgctcggacgagattggaatgtatcagcgcgtgcgccctgtcttgagctggtcatcgctctcctgcatgaatctgttctgcgaacccctttgatgacaggttagactaatcccaatttggaaatttgacttctcctcgcgtctcccataaacccgtgaaatgtacatctttacacttttctccagtgatatgtgacgtacatcaatgcattgtctgtgtgctaatgaataatatcttccttgtcacccctttacgtttttcgtctgttgccggcctgcaggtggtggcatattcacaattatgcatgcaaaaacgcggtgtcgagctcctgagatcggcctacgccaacatctcacgtagtcacgtgatgactttcaacttcatccgtcaactccaactattatcccataccctggactcttgctcatcgcatgcttgtattgctttgcatgttgacaatcgacgctcaaatgcgcggcacaattttgatactatacgctgactatcaattattacagtgttttattctccccctccgccctcagttactacttcttcggctcttgaagatatcctactacctggcctcgaagcatcatagaacttttcgcctcactccctacggaccctcgggtcaggccgtcgcacttctggatctcaatagaacccttggcccctctttcccgagagccgccagggtggccgcgtcaggctaattcgaactacgagaagccaccactttttaattttggccccgtgctgtagaagacatttccttgtcctgtcaatatctacatgattagctatcagaacggggagagatcccgagatggcacatcggttccgcctcgactcatgattccaacctagcctgataggacttccaaataagaatggaaggaaatcatgcgtggagccccatgtgagcgcacagggcatgggctttgagccatgtctcagtacaattgctggccagttcacgatcgcatacgctgtgaaaacagaagtgccggaggtcccttgtgacagacaggcatctttgaagatccttgccacatcgctggccccggctaacctgagaataaatatccgcacctaggcatccacacatgatgatatcaattgatagaatcaactccctctcgagcacgcgagagcttccgtctggctgtcttggttcaagtgaatatccttgtttccagacgaagtcgaccggcctgtgcaactattagccaaagcgcattacccttactcatcaaatgagatgggtcagcaatgcgttctgacagccatcgtctattggctctggttcatcagaacagctggtccactccaagccaccgcaccagcaatacctacgcccagtaaaatgataataccctttttgatgagtgctaattatacctatcagatgccggcgggagtgtccttgtatcttgtctcaagagtcgcatgagtgttccccctttcctcccggaggtatcgctgcgtacctgcgtagtattctctgcctgtcccgccatgtgtcggtacaatctggttcaagcgggatgtaaagtgcgcaattgcgtggcaccaaccagtagcagccttctgtccgtcagggcagaacttgctccatgtatctaccgcacggggaagaacaggcgatgcattttgggtccccccaagcatgcacacctaaggcaataggccacacacaccgtcttttgcgcccaccaacccgcacgttcgttcacacatagatttgccacgccattttcccgtcaattctctgctcgagcaaaggcccaccgcaaatgcctggaatggctaccttattaattaacctacctggccttgacatgtgtgggtgggtagaggggcatcgtctaaagcccgtgctctgctctggcacaaaatcccgagaatacggcgggcgcaacgggttccttcctttgccgacagcttctttttgcgactatctacgcccagcagcaacaccaattaggaggttggcataataacagcgcctgttttctctcacttgggatgcccttcccagcgagcggggcaggattagagcgattgccatgctggtcataaaactgcctaatacgatccttcatacatagcacacctcgtgataatcccagatgtcgcccacctgtaacccaatgtagcaatataaatagagccatgatgcccgaccatatatcgcgaccaagaaaaacaaacagacccggtcgcgccacgtaggctaataaacattcacgcacgccggggagcggatcttattggaggtttcgacggtgagaggaggtctggcttgacaggacctgaacccaacccagatctagtggcctcagggccagtcattcatcgggaggccccaaccttgaacggtttttgaaacagaaccagtcggggaagccatagcgttggatcgcaaacagcaagcacctgcacaggcgggcagcaaattgtttccccccccttctcatgcggctatcgaatcgcacaaggttcgctgatgatggcttcgctcgcacgcacggcggtaaagaggcaagggcttattgctatcgtattggcctttcttttgtgtttgggctaggccttggcttggctgacctgacctgagatcccgttgcagcggctgcgtccctcaccctcaatcgagcccagccaatccccacctccatacgttggcggacacggcggccagttgatccctgtatgaagcagacaaggcaggcgccgtctgcgaggtgtggccaggggctgcgattcattggtggatggaggcttctgatcgccagttcactgatactgctggtcctgtgcgaaaaaactgcgcgcgcgcacagaggggcaagacgttcgcgccgccaaacagcgtttaccgccgatgctattttggccgttgcaagcggctgctgggtttggcattaggtttcctcccggcgaaccgtcgcattggacggcgcaaaacaggcggcgcaaacctggacctgattacgcctgccctgtgcctgatgcgatgcgatgcgatgcgatgcgatgcgctgccctgccctgcgcaaagatgggcacaagtacatacacacagacatccactctgcatgcccagccaagtgaagtgcctctgaactaacctccagctaaccattactattgtggatcccgggtttgatggtgtcaggatggtccagcaaagcagcgtcggctgcaggtcgcgtgccattcatctgtggttgtgcgcacccttgatggcccataccacgtcgactagcggagcagaatgcatgtcagttgttgcgcctcttgggttgagatcgcagctggacaaagacaagagtgtggcgacgagggaggggtcgtatggcccatcacgcatgccggccaatctgaattgtgctagtaccaccatatgcatagatgctcctgtatggtttggctccgtttgggttcgttttgatttggtttggcctggaagggtttcgaaccattacaccagtgcctggctaattgacagcttgctcacctcccactcgccgcttcggccgtccctctgataatgatcccccccgggaacctggatggccaagcctgcgtacgtttggctggcgcctgtccacccgtcgggcctgcataggtgctaaagtatcgaagccctgcctgcagtgtgttgtgttagcgacagtccactggtcccagccgcccgtttttctggctggttgtggtacattgagtttattggggcagccggatcaacgtctccatctatggcggggtcgaagaggaggttgctgtcgatgaagcatgttactattgtcgcgggcttttcaattagcactgtaaccgcaagtgacctgacgaaaaaatgagaatggaatggagggcctctagggctgggtgccactggctgaccgtaagtcggtccatcccattcattcaatccatgtcgctttcgtgaatactcggtgcggaattgcgcaggcattaatagggcattcgagtacaaatcggaccctcgttatacagctagggtagccaaagcagaattgttgcgcatttgggcctgaggccaatccaatgcgcttgcatcggaaaggcgagctcgctagcagcactttgatggctgtcaaggcattgttcgactagtctcaatctaaagaaacgggcatgcgcactcatggtgcatccatggcatgatgcgaagcaagtcttacttccctcgatactagacaggaagttcaccgtacagtcagtcgcctaggatcgacagccagcggcacttgcgccaccgacctacctcctacatgcccaattatccagttacatggcatgctggcttttctcggattagcaacacccattgaggtgcgacttcacaacactctaggccacatgacggccagccgcccgtagggggggaaggctgtccatgtcagtccacctttcccgtagttaagcagtgtaaaagactcaagtgaatggctgagcaagcgactgaatggatgattgctcagatgattgactgttggaaaacacagctatctgttcctcgtttccgtgacttgggtggtaggtattgtgggtttgcggtttcgcaccaaatgtacctggctcccaacaaaggtagtgcagtctcctctgggctgtccaagccctcaccaaaccagccgcaacgatggcccgttgtttctctgagagggggcgatcccaagctgctctccctggtgacatgatctcctcacaagagcagtaaagtagtttcagccatgagtataatcatccattcctttcgttaagcgcgtagttgggcgggtagggagtcagatacctaaatggtaggcaggtgtgtgctgtgcgagcctgcccacacccccgaggacactgcccgagggcggcctgggcctagattccagggcgctagcggtcatcacaggcgctgccagcacccagtgtacactacagtaccgagccaggcctctgccagcagacgacaaaatcccatcgactcgcttggctcctcttttcctcctcctgcacacactccgccagattcaccgtcaccaccagcttcccaggtcgctacaagtctatctggtaagtctcctttgctctatcgtcgtgcgcgatcaccctgaaccctcaatcaaatcatcctgtttccccggaacacttgcaatattctgggtcggccgcctcactcccaaggccgcctgcctacagagcgccgacacatccaagggaccgttagcccttggatggcctcatcaatgcctcattcaacactatcaaagcctgtttggaccagcgatcgctaatactcttcaagggaatccataaacttccgtcccaaccgtcgtttcctcgtcgcccaccgtccttgtcactgcgccgccagtcctcacccaagtggcgcttaccgcccgcaacccaggtggtaatgcatcattgagccttcatcgacaattaccatcatcgacgagcctgcgattcttatataaatacaataccatccttcagggggtcagtacttcgggtttctgaagtcgacgtcgctgtcctaggaggccttggttacgtctcctagcagggcacacagcctacctcgtcagacgttagcaagcgtctgccaaccctccctcccctttccctcaccactacaataccctcaaggcctctggctataaacacacacatccccccatcacatccaccatgacctcaatgtcaccgacgagtggccctatcgggtaccccgatcactccccaggtgccgagagcgtctcccccggccagccggtcgctcccaagaatgtcgcatttgaacttctcttcttcgatgctcctcaataccgtgcgcgcttgcctatgcgagtgcaaatttacccccatgacacaaccgactcgattgtgacgacggtaaagaacttttatggcctctactcgggtccgaccggatcgaagggggttagctttgaggacaaagaaggcaatactctcattgcgcggtatgaaaacttccgcaacaacatgattgtctacgtcagagtcttcgaggagttctctacagagcccgctacatacagtcaccacccctatcagtccagcactgcgggcagccaaatgtactaccctggcaatggctatcccaaccagcgttcgtcccatgagatcaccagaccaagctcgagaacttcgcgacgacgaagtcgatctcctagtggctctaggggaagcaggagtaactcggctagcaactccagccaaaagcgtcgctcccgatcatccaagaaccgtactgcactcagccaagccgactcgtatagcgatcaccaaaatggctacagcagcggcgaagatgcccctagcaccacttcgggcagagccaaggaacttcttggcaccaccgatatcagcgttgacaacattgtcgagggtggccgacggaaaagagccaagtttgagagctcggtcggttcccctgccatttggcccttcgctttgaagaaaactaaccgttttaatataggagcttcctttgtttgcaccgccccagatgcctgcggctacatccaacccgtctgtctcgcccgcccgccgaattgaacagcatcgaccaacgctttctttcaccccgaacggccacaacccgttcaccaaccctcgccccatgcatagcgcacatggttatgccaatagcatgcagtcgaatacatacacacccaatgatcatgatggtcgccgaacccgtgccaatagtagtttgagtgggactggtgctatccttcctacacccgacccaactgtcggaagctgtatgtccgaggaggacaaggatgtcgctctgcaattaatgcgccttggcgacatgtccaatatctcccatggcagaacgtcggcgtcgacacttgacgataccttcagtggcaaggccgacgctacctcgtccactggcgctaccagcgacggtgacagtgagagtgaggacgagctccctgctgctcgtcgacaaaagcttgacatgtcgggcgcatcgcgacttatttacccaaccacagaaatgcaccctgtgcccactgccagcacagaggttgacgaggctgagttcgaaggaaacactgaggcaaagtctatcaagaacaagcccgtccctaagctcaaggcttctgctatacccaagcctgtcaagtctatgaaagtatcgacggcaaaggcgaagaaggcgccttctgttcctggcgtccctatatcccctgcttcgcaaccgccatctcgcaagcaatctgtcgtctcaagcaccactctaggtgtgcagggtgaagatgatcagcctgacctgtccaccaagccacgctgccagcggtgcaggaagagcaagaagggttgcgatcggcagcgaccctgcggacgctgccgcgacgctggcctctccgctgatcaatgtatcagcgaggatgagggtaatggccgcaagggccgttatggacgacatatgggcgtacccatcaagaaagaggaagcccttgccattactcagcctacacttctgccagctgcgcctattgccccttcatcggtaatgaccgcagacaaggccaagaagcggaagagatagcccagatgcgctcatgggtgtatagcgcaacacgttgtatgttggctggacaagccatcactttacgcactagtgttctaggctcggctacatattggcatgcgacaatcgcaacaatgaaagaaacgccaaaaaaagaagtaaaaccaaaacgactgcacaatcactcgcctttatattgagtggcaataatatgctgaagatctatcaaatatggaagttttcggtatgcacccttcccttccggataacaaggggaactgtgcagaacagctgggtttatatggttttctctcgaatcgtctggtgtttagacgatggttttttttttactcttttgtgacgaggatataggagcttgtaattatgacggtctttaacggccattacactccttgaattggcgtttgaagctatgtgggggtatgttactcttattgctttgttttaccggcactggttgtgacttcatttttttattctgtatcttttccctcggtgatatccaaggacgagcgagcgacagcgttctgcatgcgcagagcgatgcgaaagcttacattggggaggcggtgcgaaagatctcagggatttggaaatcttttactgggcaaaagcttggaacaagaacaaaaggggcaaccgagggatcctcgcactctaaatagggtgcgcgttaaggagggcaatggtgattaacggggattggtatcgcaatagggctacaaaaatggcggcggtgtgcgcgtggtctggatgagtagaactgtccgccagtcaaggacaggctcgaaggagcatgcgacttgtttttgtttccaatactttgattttctgcatgtcttattcacacaaaaattttgtcatttgaaatatcctgtgccatttaactctaccaactattcggtggtgtgcccttacttggagatgagatgctctaatgcgcgcgcattggaacgcatttgctttcgcaatttgaatatttatgcacccagcgcattattttctctgggcattgcgccccttgtgcgccaatacgtatagagcaatcgatagtcaggcgacgccaatactgggttgcctgcaccgctatttgggcagataagataaaaaaacacacaaagctatcactccatttctgatttgcgacagcaaagttgtgtactgatcggcgctaagacagatcttttcgagtggcgggtggtggttcaactcgactgttaaatctaaccttatttggactaacgcactcgggtcggtaaaccccggttgcaggggccccatgccaaaataacacccgattggcccaaatcgctgacatggacaaatgcggacattgattggttgcagataccgcgacaactgccaacggattattggctagagacgctgacaaacgagcggatccacgccgcctttcctatcctggccatttctacgtcaccgccttgtttacttgccccgcgtttcggaggggtaatgttttgatcaaaacaaacaaaaagcataacaaatcgcatgcttcgggctccccccgtcggcacgatgaaagattttagtatctggcgtcgaatgcgcttctcgggcagcgcataattttttcagaattttaacggtcggtagacggcgaggaaatggcggtgactaaaatcgcagtgcgcccacaaatggcatcgggcggtgagagagcgatttcctttttgggctctttgcacgggagaccatgtccgacccgggaccccgctccggccggagttttgtggagttcccaacagtggcggcgtaccctaaaccccagctcgccggatcagggaccctgcgaaactctcggatgagtacgagtagggtcaaatggcgctaggaattatgacattttttcgcgatgccaatctaagtgggctatgatcttaattcaatgttttttttttaggatgctttcgttggtatttgtaatgctcatttttctcggtcgcgccatgctaattgacattggcgcattctgttttcggaccccttgaaacctttgctgtagaagttagtggcctcacctgcttagataattacggcctgccgcaaacaggtaggtcgcaacatgctcagcttcacctcctatcgtcaactgaagggcgcggcgcatccgcgggctgccatcggcttctggcttgacttgccaactttgatgtgcgatgcactccaccacacatctgaatatttgagccaactgggaatctacccttcaccttgtaggccccacctcgggggattctgcgattgattacagtggagacggtcgctggaggacggtctttgtgcccgactttcgcagaaatagggcgtgaaggtggtaaagacttcgcattttattcccggtctagtttagaaaggaaagcgacaccggagaggactaatacgtatgtatgtattctcccctcaatacgaccgtgtctaaactcgtgaatgatctgtaatcattattcttgttcatctaaacatctgtgaaaactatccaatgatccagatatccgtaggttgtcgccttatcccgaggacgaatccaggcataggttactgttgcacacgccccgaccaataagtccaacatggcggaagatgaggagaaggctgtgcgctctgcccccgtcgagcgaacaatctccaacacggacgcgcctgtcccctaccacgatgcggacgggaactttaacccgcctgaccggggccttctcgcctggtctcaggtcctcgccaccctgctcatcaatgccttgtgttggggatatcctgctgccttcggcgtatatcaactgtactacgtcgagacgctcaacctgccctcgtcccaggtatcctggatcggctccatccagatcttcctgacctttgggatatgcaccgtctcgggtcgcctgtccgatgccggctacacaaggcactgcgtcgtcggcggctgcggcctggccgtgctgggcaccttcatggtcagcctcgccaccaagtactggcagatcttcctcgcgcagggggtctgcacggggctggggctcgggatcgccttcatgccggccatcacgaccctcagctcctacttcaagaagaaccgggcctttgcgctcgccatcgccgcgacgggcacgtcggtcgggagcatcatcttcccgtccatcgtccagtacctgatccccaaggtgggcttcccctgggccgtgcggtgcgccgcgtttgtcgccctgtttattgttggacttgccaacctcctcctgaagccgtatcttcccccgcggaaggctggccccctcgtggagtggggtgctttcaaggagcgcacttacgccctctttactctcggggcgttttgtaacttttatacgctgtattttggtttcttctatgtaagccggctgaacgtccatgtccatctgtcgtgtgaatgttagccaaccgaactgacactgtggtagattaacagttatgctcgaaccgtgattgggttctcttcacaagaggccgtgagcatgattctcatcgccaacgccctcggaattccagctcgcattgtcgtggggtacctggcggacaacctcctgggcccgatcaacatgtacctgattgcgctgtgctacctggggaccatcacgtacgtgtggatgacgatacagacccgggcggccatgtacatctttagcgtcttctacgggctggcggtgggcgctacccagggcgtctacgtgggagcgctggcgagcctgaccagcgacccgcagaagatggggacgaggttcggcatggtgtcgaccctgtccggcttcgcgaccctggcagggcctcccacggtgggagccatcatcgaccagtcgggaggcgactataaatgggcgcaggtgtggggtggaacgcttgcctttggggcggcactggccgtgttcgcttctcgcacggctgcggttggcttgaagttcaaggctaggttgtgagcagttatggacatgcagattgggaaagatgaaagagatggatatgtggtttttgggaaaccaagctaatatatatggttcgctataatgagagagaggatgggtttacagccagaaacatgcttgatgttggataatatttaatctgaaaatgttttttttctcggtactttgattttagtctataattccgtatcacctacctttatggagatttctccaaatgttccagagccaatttgatgaggcgacatacctgtgaaccctcctgccatacatggtcgtgctccccagccagatctttcagagtcaagagattggcatcgttggcctttagcttcgcgaccatttcatcaatctcgggctcatctacaagggtgtcttcgggcgaccaggccaaaatattgtgggaaggcagatggcgcccgctgatgtggtcatccgggcagcaggcaggcgaggcgatcccccatctggacctgtcactgctaaacgcagatgtgatgaacccagcatagttcccatcgtgacgctgatcaatgccatcgaggtcgtaaatgccagaaatgccgatgatggtcgtcggcagtggtactgagggcggtggtacctgaccatccagcacgtagctacccatgcagagctggtacgcgagggtagcaccggcggagtgaccgacgaggatgtacctgccgctggcgaggtcgtactcctgcacgaggaactggagcgcggaccaaacgtcgttgatgtggtcggggtgtttggcggcacgcagctccgacgcgggggtttcagggccctgggggtgtttgggatgtggcgagagcctgtagtcgatgcttgcgaagccgcgtatgggagcgtgggctaggctgtcgtacgaggcgaccacatgcttgatggaggggatgaagtcctcctcggtgtttctggggtcaccccatgcgcccccgtggatgaagctggccaggacagcgggttggtcaactcaagagctcttcttcgctcattcggtttgggttgcttacatgacccaggtgccacctgactgtggtttgatgtctgatgatggctcccacacacttatccgctggcggacattgtcgccgtaggagtggcgcgtgtgcctgagctgatccattgttggctgtgatgcgactgggctgcttgtgtttgggcggcacgtgaaaaagcgatacagctcaatgggtgtacacgaagcggggttctggatggatcggctttgacttgtagcaccttagtcccaggtacaacagtcaggattcggatcgttctgttgcgttatatatcgtggatggttctacagccgctcccgtggtatccgcggtagcattgcaccatggatgggggatgcggatagattggtgaccactaaccagtgcaatagccgctagaattaggtgattatccgtcccatcatacgccgtcgcatcactgtaatgttccgtgccatgttcaatgttggcgggggataatctagagcggtaactcgctgcaacagcctcgtctccagcgggcttcatcagtcctacaaaaacatcatcaaacagcaggtggtctgtaactcaacctgtcgcagttacacccgagtgtcctgggtttttctttttccttgcctgtgcatctggttgatttaggtttaggtactaatagtgtatgcgcctcctttccccttttgaatccgcctttatgcgacctcgcttctgatctgcaaatgctgtgcgactattcatgcgtcagaagcgctttggactcggtgcaggtggcacattgcggcctttttctggtctgtgagatacatcattttgatcaatcacttagctgaaagccgtgcttgttagcgacgaataagcagtgcctgtcatacttgtctttgacacacgtgaaacaaatccctatacctggatcattaacgatttcgtggttgtgttcaatggcaccaaacacaaaaacatacagtagagttaaccaagacccagaagccttcagaaaatgacttgctacatatgtaatcttagggcttctcaagataaataccagtaactacaagctgataggtgctgcaaaagcagtcggattaactaagacctagaagccttcagaactaagtctaaaacagcaagctatgtagtccgctcaactttagcaactaggtaggatcttagttaatacgactactttggcagcacctatcagcttgtgattgcttgtatttaggtatcttaaagagccctaagaccatcaagttatccagctggccatccctgataacgcgcactgccacctgcggtttgctctttggcatctttgtatttgtggttggccaagttcagagcagatcgggcgagatttgatggcaagcgcaggctcggtgggatgttcaaaacttgagttggaggggcgatgaaggcagcaatgtgcgagacccgactgacttggctgagtagcgatgtaatagacggattgtagatgtggacttgagctgtatggtttagtcaggccggggacagcagcctttaaataggtagaaagcagcactttgaggttcatgaaaggagacacgccgacaaaagagtcattatgcctggcaaaagctattgttggtgttagaccttatgtacggccgggcgcaagcctcgtatccaggcaaaaaggctgaagtttaatgtgttgtgatactggaaatagtgtcaagttggtgaattcttggtgtttgggaattccattccttttcagcagctgccacataactgcatagctctctcactcacttcttactacacaaaaacatgctctcttttgtgaagagcctcactggtctaacacccggtttgattggactccaatcgaataggaggggtatgatgctccggactctgtgctacggctacacgagcgaaggggagcctggcgcatagctcgttgcggggaggtgtgagatcctgatacctttgtccctctagcccttccacaactggcggctagggacagcctgatgtattgttatacaatgtcgggaggctgtctatttcatgatcactagcttgtacctacatgacgtacaaactattcgtgcttccatagctgcttgttgctctctccctttcctgtgacacgatgcaaaggaaaagttgtgcgctcacgatctgccgtgttacgctggcgtgaatttggtactggctcgatactacagacgcatttggtagactagtttggccaaagcaaacggagtttgcgttgttgatatgggtccttggcgagccaatgatccgagttcaatgttgatcgcttcgctcacttgcttgtagatgcggtggacctgtattcatctcgttgcttgctccgttgctaatggctaagatggagcgatttatatcgctcgctcgtggccgatcgacttcaaaatacttcctctcctctcgtaaccgatccgaaggaataagttttgacattttttttttatcaggatcagtgatggagaaccccggcgttgatctctccgaaacgaacggcacacgcctgctgataacgatttccatcttcttggccttgtcatgggttgctgtcactcttcgaaattataccagggcgtatctgattcgttcctttcgtaccgatgattggattatgcttatagcccaagtgagtgctacagatattccatgcgaattggtggtgatggagattctttctcaactgactgtctgtaaggtgaccttcacaatttactcgggctttctctatgctgggcttgaggcgggcataggccgtcataatgccgctatagaggatgccgatcgtgaagtcgctgcactcaaggtgagagtcagatgtacgtaatctaaaacttcttcgattatgttgacttggccaagtggcaagctctggcaatcagcatgtatatcgtactgatgctgctgatcaaactgagtattggattcttcctgttgcgtatcaccattcatatgacagcgtacgtgcggataatcagcgcgagtttggcacttatattcctctccagtgccgttgttttcttctggaatgtcttccagtgtatcccagtcgagaagcagtgggattatcgtattacgcatggacagtgtgttcggccggatgaaattgttgttgtggcgtacatcatgagtgccatcacgatagtgacggacttcttctatgtgagctgatcttctataccggttgccgctttctctggaggctgtatcaaaacgaaagaagactaacaggagaggcgctcgcccttcgctaggccctgatccctattccaatggtttggaaggtcaagatgactatacaggcgaaggcgactgtggttctaattcttggaatgggaatcttgttcgtcctatctgcaaaaatacatgtcaatggccttactgattcgtgagcagtgcaagtgtggcaaccattgttcggatccgattgctcccaaccatggccaacctcgacgatgtgctctgtatgtacccggaactattctcacaaccaactggcccactaccaataatgaataatttttttgactttgacgaagatgctggaacagatgccatgatatggaccatcatcgaggctggccttgccatcatagccgcgagcttggccactattcgcccccttctccgtgtcttgcgtgtccgaggttttgaatcttcagacagctgcgagaatgttgaaggcttggacctgcaagcgttggaacctcggccagaccgacagaggcgatttctccagttctatggcatcaatgacatgccgctcacacacgacactcgcccggctaccatcttttgtttccatcacgacgacaccaaatcgcaacatgtgcaactggatgatactggaagagagccttgactttcacagagagcatgctcgcagtattgggaggatacgggaggcagactgtatgctggccactccataacagaacctctggcgggctggagtgggcggtatatgtagccttgtaggcttttggagatgggacgatcggcggactatggagattagacctttggtgagaaggatgtgagagtatcgccttgctttttttgcttaatgttatttagtgattcaatgtggcggttctttttcctgttggccgacaaggtcctggacttgagaaaggagagccttatgctgaatattcaaatatgtgaagatagttgctcaaagagtatttactccgggttgaaggagtcttcttagcgtcacaaagtaaccaagggagggtattttctcttttatttcctctattaataccattttcgacctttgatacccttgcagttgcacagagaaaaagttatatatgacccaaactcctgtttatcacacttttcgctcattaatttgccgtgccttcatctactaccagttcctctggcgcgacctcccagtcgtcttcttcaccccaaacaggcgcaagaacgaaccggcccatgatctttcccattcccacactctcgcccccgacagcgttgggatcgaccttggagtcattttcttccactattaccgcggtcgttaagaagttcattgccgtagctgggctcacttctagaatctggccaccccagtccagctcaaccttaccagactttcgtaccttgagctcaccaatcattccaccctccgaaagcatggatgacaggaatcccttgccgtcatccatttcgtcatcgtcttctgcgggttcgggtccgccggtttgctctgcagtgagatcaatcggcgcggtgggtgcagagtttagcatgtccaagtcttgaggctcgtccttaaccctgggcttgggtttcgcttctgcgcttttcttcagtggtgggaggagtggcgggaattgccaaaggtacaggcgtccgtccttatccataggggcttcctctggcttttcctctgctccctctttcggagcaatggcgatggtgccgagctcacttgctagtagatttaaatccgactgaatgatagcttcctcagggtcctgaggcgccgtcttcttgactttgatctcgactagaggtttcttcccatcctcaggcgaagagaggctgggatcgatatccatcgcgccctcagcatcctcttttttaatgacagtagggccgttgtctcccgtgtcccagactccctcctccctggcttgttcagggatgggccgtgccgggctatcttcatcaacccacaagctttcctcttcttcggcggcgttctctgcggcttccagctctttcgtagtagcgaccacgactccgacctccttatgttcggttcggtagatacccattggcataacgtccgcggggcgcgatgtgagagcggccatggtagcttcatcctcgcttcccagctcctcctctgccgccatggtgtgtagtttgtcggcattgattcttgcttcacgatatcggttggcttccctaaagccctcgccctcagatttggcgcctcgatatgaaccaccgccgccgcccattctgaaaccaccaccgccaccaccaccactgccgccgccgccgccacctccaaaccaaccacctgcgctacctacgagccgtaagcctactgttcaccgaaatgtgggaccatgaagaaacataaggacggggaaacataccggatattccacctgagaaaggcccggtggcagcacctactatacctccgcgacctccccgagcgcccatcgcatttccacggctgcgcttgctacggaaccgcgagcggccccgggcgcggcgctcctcggcatctctctcttgggccttcttctcctcttgcctcgcaagatctaatcgttcggcctcatctctgcggatgttcttgggacggaaccggccgacggtgggtgcccgcgtggctcgtgaggcggctgtggaagctcctctggtggtggcggtagatgcggcgggtgctgctgccggtctggagctggctgaggcggcggaactggcggccccacgggctcctctacccgaccctcgaccgcggttcattatggtgagggttctagggagcaattgttggagagatggaggtgactgcaatcgattgctcaagagcttgtctgactccgacgctgtaaattttggcgggttgatgaactacactttttggtggggtcagtgacgcatccctgctgatagtgatccaagcccactaagacttgcgccagccgctgtaccttaggcatgtatttggatcgttcaagaggtacgagttgagagacagggagagagagagagttggggccagaaggatatatattggtatagattttcattaaatctgggtccctgtattgtgcgttcgtagaaagaaatatttcattacacattggtacatctatcaaatggcatctctacttttggtttgcaattattattgtacacacatcaaggcctcgctgccgaaatgatgtgcaatactgccttctcttacaagcatgctgccaatccaattcctcccagcttcgacagtctttgcgccaaatttgacgatgacacagcctcggacgttagccgcagaccatagaacaccttcctccttctccttctgtatcctgttcgagctccagcgttccgactcggactgagctgcctcttcttgagctttgtcttcggcggaccgaaagtctcgagctccaatgcgaggaagggctgcgaattcacttaggaagaaatcgccaaccggcttcatcaaatgacccctcagaagaagggtgccgaaaacacccgtcttatgcattgtttctttcaaaggacgccctaggagaaggctgtcggggccagagaggaccacagtgtccctgaccaggagtctatccttgccggctgcctcatctcctctttgccatatctcgttgcggccggtccatcgaatgaagctccagtcttctcctcgagcactccgaccttgggtcacccagtctaggaaacatatcgacgcccgtggtgccagtttgaaaatttgcgtttggacgtatacactgctttcaaatggttggactgggtctgggaggaggcaaagacaagcatcatcatctactcgcacttgcagggtttggctcgttacgacgtcaggtgacggcgacttgaacaccttggtatggccctgtgtgacgaggctaagcttggatttctcgtggacatgaattgagaggttgacgctatcgcctcccactaaaccacccccatatgataggatgaagaccaagacgctcctctgatccgcagacggggaaggggatatcagtttcagaggatactggtatgtcattgcctcgagactgctagtcccagcaggtgacagtttgaccacgagacgtccatcgccagcgcgagatgaggaggctgggaaaggagaacccattcttgtattgcttgtattgcgccgcgccgcctctttgctgtgagttgcgaagaatctctgaatgctgaaattaggacatcgtctattcatcagtctacaacgggagcggcattgcagcttccaatcgagagcgaatcatagccaagtcatgcaattcggcgaagagagagatccattatgttgatggacgccaatgatgaattgggctacggtgaagataggcagctctgataagaagacacccgtttgcatctgtacattacgtaagtagccagttacaactatggttgtcgaaactctggactattgtttatgacatgtatcaatggctcttcgcgctggccagcaaaaaaaggaacgcggcgaagagtgttcagttacatgtaggtaagcacatgtcggtgcatggcacaaatcatggaatatttcattaaccaaacgcgtcatttggtctcacacttagatggtgtgtggctgcatgcactggaaggtaacttaaggtagagatggtgcgtagaaggaacaggggaatgatgatactaagagcgcattggaaaattgagtcaattacgatttgagcgcgactgcccaattctttgcagtgcgtgtgattgcttactcgtacctgcctctgcattatttctcgaacgtcggcacagagggtaaagtaatttatccgacaatctgccgggcggcacatcagctccagtgctctgcccaaataaacccttttgcggcggtgcaactctcaacgcgcccagcgggtcgccaattccactttcaatcgcttccaccggccgtggaaaacatccccataacgcgaggcgaccacaccaccaccggatcaggactattacgcctggttttggctcctgcagatgcagactgctcgtttacctctgcgacaaattatggacagcaacggcaatccgagtccagaccccgacacagcggcgcgtcgccgttcgggacgcgtcgtgagagcccccgacaagttctcacctgaggccgcggggccctcatcggtcgcgaaacgcaagcgcgacgccggtgaagaaggggaggacgacgagaacgatgacccagaggtcgacgacgaaagcgacgaggctgatcagctttccgacgacgagcctgccccctccaggagagcgaggaaatcgtcgcaaaccaagcgcgcaaagaaaccttcagccaagaagcccaagatcaatggcacgcaacacgccacggcaaacaacaccgttacgcttcctcgaatgcccaagaaggtcgtcagacttgacacaggcgacaagggaaccggcctctatggtaccatgccagcccttctcatcccttcatgaaacctaagaattgcatggctaacttatctctcaagctgaaatcttctcgcagggcaactcttccgatactgtcgctcagcagtggctagagagctacagaaaagacacgacggttgccctcctcgatctcatcaattgtgttctgcagtgcatcgggtgtgagcaggaagtcacaattgatgatatccgcgatccggacaacattccaaacagacttcgtgatcttgaaaattcttatttagaggtacgcgatacccctgcattgttgaagtctcccctcccgaggctaacctggctctcatcaatagcaacaagaaacagaatatcccctgatatccaggtcaaagtcagcgaagtcatttcgcgatttgcttctgggatttgttgcatcatgggtcgagcttttgcatgaatctgagctcctgtacaaagatgaggaggtgatggagaacgtgcagagttggttaggcagcatgtcctcttcccgcgtccgatcgtttcgccacacagcgacaaccatatctctttctgtgacctcgggccttgtcgaggttgctagtactctggaccatcgaatcacaaacattgagcaacagctacaagcttcaaaacgtggtaagaacaagccgagaactgccgagtttcagcaaaatcttgatgaggccaatgagtatcgcgacaaatgcaccaatatcctccagggttactttgacgtcgttttcgtacacagatacagggactcggaccccaagatccgcactgagtgtgtcgaggcgctggggcactggatatgggagcttccaacagtcttcatggaaccgagttacctgcgataccttggttggatgctctctgacacctacgggccaacacgccaggaggtcctcaagcaactggccagaattttcaagcgtgattctgagcaactcggtcacttcattgatcgattccgacccaggctggtggaaatagccactcgcgatgctgaagtggctgttcgcgtagccgcaattgctgctattgacacactacgtgaagcagctttacttgtgccggaggagcttgacgtgattggacagctcatctacgacaatgagattcgaatccgcaaggctgtcgtaggcttttttgtcgcctgcgttgacgaagtttttgcaagcacggtccaagcgctaggtggtacagatgctttggatgaatttgacagcactgatgacgatgactataacactccgcgacgggaatgggttaatatcaaatgcctcgccgagacactgtcaggctacgattctcagattgaagagcgccaacagaccggtggcattgctggtctggatgtcgcggtcgatctactcgctacccatgctccggaaaccagaatttctcttgcgtcacaggtgctctatgagagagtcccagagatcaaacgctggcagctgctggccggttacctcctctttgaccacactacaagtaccaaggccaagtcaagatcccgaaaagcagattcacccgaagcagcgtttaagaaggctgtggcaccttcaccggctgaagaattgattcttttgcaggttctggtatctggtgttaagttgaatctcactcatgtcgttgaacccgacaagggaaggcgaagagttccgcgccacgatatcgaggcggcacaagaagatattgcgattgagctatctgacatcattccacaacttctaagtaaatttggagctgagcccgaaacagcaactaccgttttacagctggaacacttcgtcgccttggaatctttccagcagttacggcaagatacaagcaaatatgatgctctccttgatgaggtatgcacacagttcaacagacatgacgatatccgtgtcatctccgaggccacagctgcccttctgcacgcccgccgacaggaggaattggaagaactcacagacgccaaattagccacattgtgggagagcaatatcaacgcattgcgcaatattgacaagacttgcgagctttcagcgcgtggtaatctggctgctggctcattgaagagcctttcgattgttctcatgaagatcagcaagctgtcgggaatttctgattgcatcgagttgctcgaagccgagggttcgtcggacgactcgagctcgcctgtagttggtattcttagcaatatcgttcatcgtggaaaatttgagcctcaggaggatgagattgatgatcttgaggatgaagttgtgtcatacgccatcaaagcctgccagttctacttcatgtggaaggtccgcagtctatcgaaactgatttccgatggtgttggtgtcttgggcgaggatctggaccgcctgttcgtcttgcgatcaacgtaccgccgatacctgattgaaacattctcatcccgcgcagcaatcgatgagcttcgtctatttgctaccggctgcctctgcgaccttcacctcacctttgctactctccgcacccctattgaaaactaccgcccttcatccagctctgcatctcactcctcagcagacaatcttcagaaactggtccaggatatcgagtctggccttgtccccgagtttctccaaatctttgatggagcagagaagcaatatgccaaacggagcaagagagacaagaccttgaacacgcctgcagacgacgacgagccgattgacgatgatcccatggatgatgagggcgagaatgacgaagacgaaaacttgaccccagaagagcgcttcgcagcggagctcaaatccgaaaaggcgctttgcgagttggctgccaagttggttcttgccatcagagccaagatcattgacagacgtggctctgaagccagcaagcttcgacgcagactccaacgtaactctacaaaactggggaataacttcagggaggtcgtcagctatctggatgagtcgaagcgtgtcaaacaagacaagaagaagggcggtgctaagacagacaagcagactctaagcaaagagaggatcgaggtcgatgatgaagatgaggatgatctagaggtagaagaaattgaggacgtcgaagatgtggctgacaacgaaaaagaggatctggagggcgagctggaggacgatcttattgaggatgtcgacgatgagccggaggagcggcagaataatgaccgggatgacagtattcttggggattaattacagcccaacctaagtttcctttgcgttattcttcatgtttgtctttttttttaggtttatgaagtatggcagaaggtgccaacgattttgttgatgaaaagggaattggcatgttctgtagtgaatgatcacatatttattcagagttcaaatttcgatacttgtctatattccggcctggttcatggtagtgtatatagtgcaacaaacaccacttcatgaaatgaccggttttctcagttgagccatttagtcaggtgaaggaggacaattgcagcaagatgaatgcgttgtatggccgtgtggccctgatatgtatttcaaagtttcgtttaacacggatcttgtttcttcttaattcccataaatggccttaatcctctacaattttagtcccgaacagcccgtataccctctcccagcgtttgttattccccgcatctgctttggtcggatctgactcacgaacctttatgccatattggcgaatgcagcagttgaagggcaggttggacactttgctgtcaaagttagcattgtccttgttgttcccgtcgccctcgttgtccgagctgtctggcggaggggggtctcccgtgcggaattgattcgccttcttggccgcttgacgttgctcgcgcttgttctcctccaggttgccccagaggagaaacatgcgctggcgcagcaaatccaaagtctcgacatcgcgtttcaggtcggtggcgtcgagattgacaagacactgcgctgattggttatccacaacaacccagacccgttctctctgcttgatgtcgggtgtggaatcttccagttcaagcgcgaatcgccattcccagctcaccgagtcgtttgccatgtcttcgtcatccatgcctgaactggagtctgagtccccatcgtcttccaagacgtcatattcagaagtcctcttggggacggcgaattgtagtatatcggggggagagaagttggtgatgcgaacgttgacacgatagttcatgtttgtaaatggcattggcagcttcacttcctcgccatcaatatccagatcagcagacgcgttggtgaggatatctgataggcaactagtaggcttggtgtggttttcgcatttgactatggtaaaggttagagaacatgtattatcaggggctataggagggaatttaacacaccctgtggattcattttttgtgtagaaacgggcgtgtctggttgttgaatattctgggcaacctgagcattctgggcgttttgggcgctcttttgcctggctctcttctcccttcgtgagagtttggaatttggtacaggctttcctcctgcgagagcatctgacttccgcttctggccagcagcagcagcgtcgtcaatttgcttcttctgggcctttagactccgctcgtatgcgcgttttcgctcaagagctcgataaagtcgaggatccatggtatcgggatcttcatgaaaattcaagggaatcatattcacctttgattctccaaactgtcgatcgcctcgtagatacccctccaagttggcaccattctggccatattttacttgcacattcttcagcatgacccaatggcctttgccagcctctgacccagttcggattgcttctgcatgggaatcgtaacaggtgacttgcatgctgcgcttcccaaacgggccttcccaagaagaggttgtggggagatccttgctgaatttcgcctggtagccataggggtctccttcctgtaccacagccgtcttagggcctttgtattcatggtggtaaaaggcttggttctccgtaaagtcagagacccacagagacatcctgtctccggaatcataggccctaacaatatagaccagtaggtcataaaacgtgccatccttgaggtccttcaactcgctaaatttttccttgaagttgcgagactgaatcactcgcgtctcaaattcaaattcggttgggattcgtgttttatcaagcccatggtagctaaatgggatatgtgcgagttcaaccttgttgagggcccttttcacccttgaggtggagggactgaaagctgcagaggcgtccgccgggggacgggggattttgcttcctgtgaaaaggtatattccagactcgcgatgagttagaagagagatatcgccaaacccccgtttctggatctataacacgtggttaacaagaatgagccaatcaggggatggtggaggacatactttgagtctcagcaacaccacgaaatcgccgcgggctggctttggcatatctttctgagggagaaaaatgttgatagccagagaactctcgtcgttgtcttctaccgacttgtcatagattcgcatggtgctcttccagtctgagttttatgtaagcggcgttcatagttggtgattcagcctcaatgtacctgatccttttgtagcccttggttcctgaacgtcgatgacaacacccatggaattgataaaaactcctgttttatgatctccttcaactatttgttggactgttgtaaagccaggaggcagcgcgtctggcgcgagctgattggatggagccatcctgagtagtgtttctccggtacatctgaatatcgtattttgaattcatacagataaaaatcacggatcagattaccaaggtgctctgcggatatttgcgacggcgttcatagtcagtaatacttgtcgggtagcccgctcacagagatagccgcggtcggtaagttgggcgcgtatgagacaggtgagtactgtcgcgagatcatgtgaccaagaaattctgggagcggctcacacagcctgatcgtcctggcctcgaaacaccgcagttctacgaaagaggaatgctagtagtcttgctttgtcacgaatacgacacgagctaagggaagacacactgtacgacaaactctcatgcttcataccaggctcatcgtccaagaacggaggcggaagaagtcatgagccaatgatggccaccggctttgtctccatatttcggggctaagtcagcggcgaaacagcaggctgcaattggctgtgacaagctcagcctttgtgcgcctcatttgtgcctcaggcagtaggcggccccctccaaagcttccaggctgttttccaccccaccagctcaggagttggcggggcctccgctttggcgctatgggctggccctggttgttgctcatagtgacagggcactggaggttcgccttggcctcaaaggcactgaagtttctcctccccccctctaaccttcttccaccatttacctcgaatctcttccaacatctcccacctacgcgactcttccccgtctgctgagtgctggactacatctccatctgcttgcatcgcacacacgtcgctctgggcattttgtccatctacttctctttccttcttggatttccatatcctgtcttgtttttcttctcaccggatcgccccgcacaacaacaccgccgacaacatggctgaacgatacatcccagagcatcgccggacgcagttcaaggcaaagaacaccttcaagcccgaagagcttcgccgccgccgcgaggaacaacaagttgagattcgcaaggcgaagcgagaggagaacctggcaaagcgtcgtggcattgggtccggtgagaaccgccctggtgctgctcttggagctgcccccgacagtgatgacgagtccgctcctaccgagtctcaggtatgttttcctcccattttattcatgtgaataccctcgcatggctttgtttgttttccccttctccccacttgcctatgttttttttccttgtcattgtttgtcttggcctatgacgggtggagggggcaacagcgttcgtggaaattatgaactccacctcatagcgcgccgccagctctgaacctggtccaagatacaccctcccaaattgcctgctgcatttttttttcttattggacaatggggaaatagaaagcatatcctacctggctccccgcacctcaatcccgtcactcgggtcgtggcacatgtatgcggtttactgactagaaatcatgtgatagttgaatgaggatctccctcagatggttagcggagtcttctctgaccagattgaccaacaaattcaagccaccaccaagttcagaaagttgctgtcaaaggagcgaaatcctcccatcgaagaagttatcaagaccggtgtcgtcagccgattcgtcgagttcctcaagtccccccacacccttgtgcagttcgaggctgcatgggccctcacaaacattgcctccggctctgcgacccaaacgcaggtcgtcatcgaggccggagctgtccccatcttcgttgagctcctttccagccccgagcctgatgtcagggaacaggctgtctgggctctcggcaacattgctggtgacagccccagctgccgtgactatgtcctcggctgcaatgccctgaagcctctgctcaacctgcttggcgacagccgcaagcttagcatgctccgcaacgcaacctggaccctcagcaacttctgccgtggcaagaccccccagcccgactggaacacagtatgtctcctcaaagtcccaacgcttatttggcaaaccactctgacactttttagattgctcctgcccttcctgtgctgtcaaagctcgtctactctctcgatgatgaggttctgattgatgcttgctgggctatttcatacctctccgatggctccaacgacaagatccaggccgttatcgaggctggcattcctcgacgcctgaccgaacttttgatgcatgcttccacctctgtccagactcctgcacttcgctctgttggtaacatcgtcaccggcgatgatgtccagactcagctcatcattaactgcggtgccctgccctgcctgctctccctccttagctccactaaggacggcatccgcaaggaggcatgctggaccatctccaacatcaccgccggcaactcttcccagatccaggctgtcattgatgccaacttgatccctcctctgatccacctccttcagaatggtgacctcaagacccgaaaggaggcttgctgggccatcagcaacgccacctctggcggtcttcagaagcctgagcagatccgctacctggttacccagggctgtatcaagcctctgtgcgatctccttgtgtgccctgacaacaagattatccaggtcgctctggatggcctcgagaacattctcaagattggtgacctcgacaagcaggctgctggtgagggtgccgagtccgtcaaccgcttcgctctgttcatcgaggagtgcggtggcatggagaagattcatgactgccagaacaacgccaacgaggagatctacatgaagtcttacaacatcttcgagaagtacttctctgatgaggaggagaacgccgacgagggaatggcacagcccactggccccaacggcacctttggctttggtgccaatgggcccgcacagtctggcggcttcaacttcgccaacggaggcgactcgatggacatgtaaagatcgaggactgaacactaggcgaagtattttcccttttggaaccccgaaccttgggatctctcgttctacatcacggcgacctgtccaagcatgggtccttgagattgactagagtttgccaaaccccaacccactgtcaccctggaagacattacacatacaataccccatcacgattatgatttttatacatcaccccacatcaccccacccccttttcaccaggatggcatatggcatcgcttaggagacctgtggttgtatcaccgagcgatggagagtagcggcatcgcaggatatatggaaggcccaacggtagcttgaaagctccggcctcgagggaattatcagaaatgtaatgagagcagcatatcgttgggatttcaatctcaagatgaagtggtcgtgacagctgacagattaaaccctgaatctgttggttttgtctataggagaagaaaactgatcggcgtacgctgctgaggaaagggacggtctgacagccagcaccagtgtgttggacttgtcggcaaggtttatctatatagcctacatacagccaagtggctgagagcgttctagttcctcatgttgaactaagaaaagaaatttgtctacaaattgtatgaactatttgcgtgactaaagtgattcctaaacttggcttgattgtatgtgatgtggcctttctttggattgcgagagttatgatcttgcttgggcgttttctgctttatggcggggtaatttgtgtggataagagagacggccatcggtatggcggggcaagaatgggagctgctctggggtggtgaaaaaaaaaagacacactgtatgattgtattactgatgcttgtgcatgtacagtgcgaatagcagtatctaaaaaattgtcagcacagtctatgctacacgaccacctcttttgtgccccttactccctggtgtcgatatattgggtgactcgggataataaaaattgtatccgagtttggaatactttgtttcccgtctcatagattctccaaatatcaagcttaggtgctgaggagttggcgaggagtattttctctccgctagtgcatgtgaaaagagcttgttgacagcgccaaacacatccggctttgggtgacacaaaggccacacacttgatatggcaaagaaagggaaagccaaggcagagacgccgacgccagccccaactggggcagccaaagacggtgcggcgaagggcaaaaagggccagaaaggaggcgcggcggcggcagcagcagcagccgtccccgaggtgcccacggcagggccgccaaaaccgacggtgaagcagatcatcggcgggtcgtcgtggacggggaagctccccgtgaacctgctgagcgagtactgccagaagcagaaatgggaccgccccgactacgacacgcgcaagacgcccgaggggttctcggtgtggatcacgctgagcgcgagggaccccaagacgcaggagacgacgaggctcgaggccttcaagatccccgcgagccacaagcacctgatcgtgcgggacacggcgctcgaggccaagcactgcgcggcgacgtacgcgctgttccgggtgtgcagcatgcagaacaagcacacggtgctgccgccggaccacaagagcctatggaaggagttccaggcgctcaaggcgcaggacgtcaaggacggcaaggggtggatgtacgatgcggacccgttcaagacgttccacgacagggcggacgcgaaggccgcggcggagaagaagcgtaaggaactggagcaggccaaagccaaggccaaggagatgcctggagcatctggcctggcactcctgagcaacagcggtgatgggtctggccggtcggcgaatgccatgaaggggtggaccatggcccccaaggtggagatgggccggcagacgagatcgcagctggaggggcttctgagaaagggtatctcttggaacccttatggcgttgagatgtccagagagaagatcgcctcggtgaaggccgagcttaccaagctgggattcaggcagagccacgttgacgaggcggtggggtactgcaaagaccgagaggagacgctcgaatggcttcttatccatgtgccggaagacgacctccctaagtgggcgcttccagagcgctacgcggtgggtgtttctatcggagctaccgatctcaagaaagaggggatcatcaaacggctgtctcaaagtggctactcgcaggacctgtgcgctcgtatcttgaacgagaaaggcggcaatgaagaagaggccgcaagcgcgctgcaagatctattatgcgggaggagtggcaacgacgaggatgatgatgatgtggacgtcgccgacttccttgatatggggtcgccgaaggagcagtgggacgaggaagtcggaagtttggaggcgatgtatggtgatcacttccaagccatcgatgacaaagtgatccagatccgtcttgagtctatcaaggacaaggtccacggacaggtcgaggtctccttgcagatccgaatggcgccgtcgtacccgaagcgactgattctgggcattgtggccaaccttccatcatatatcaaactcagtatcaccaagaaggcattggaatacatggacacgcagctacgggaagaaccgatgaagatgttcctggttgctgattgggtccagcagaacatcaatagcattgttgaaaagccagggaatctcgtggacatctctgctgtttcgtctgcagcctccgagaccaaggtgctcgccccagccaggcggaacgggaggtcccacggtgcaccgagaccaatcagatggattgagaatgcgaagagcagggtgtcgtggcttcgaagacaggaaacccctgcatggaaaaagatgtcagcccagagacagaggctacccgcatggcaggttcgtgaaacgcttatacagactgttaacgacaaccatgtcacgattatcagtggtgagacgggttcaggaaagtccacacagtcgatacaatttctactggatgacttgtacaatcaggggttgggtgagtgtgccaacatgatcatcactcaacctcgacgaatttcagcgctaggactagcggatcgcgtggccgaagagagatgtacgagagtgggagaagaagttggatacacgattcgtggcgagtccaaacgatcgaaagatacgaggatcactttcgtgaccactggtgtgcttctccgtcgactacaaacgtcaggtggcagagtggaagatgtcgcagcttcattggccgatgtcagtcatgtggtcattgatgaagtccacgagcggagtttggacactgacttcttattgaacttgattcgagaagttatgagaacgcgcaaagacatgatcaagctcatactcatgtccgctactctcgatgctgcaacattcaaagattacttcacttccgaaggactccgagtcggcacggttgagattgccggaaggacgtttcccgttgatgagtactacttggatgatgttgttcgcatgactggttacggtgtaggggagtccaaggatccatacattgccgatgagaccatgggcaaaatcattcagaagctgggagcccgtatcaactatagtctcatcgtcgaggcggttaaagctattgattacgaacttggctacgaaaagaaatcgggaggaatcctgatcttcctacctggtgtaggagaaattaaccaagcctgcaacgctctgcggtctataacatctctccatgtactggccctccacgcctctctggagactcgagaacaaaaacgggtgttcgccaaccctccgcctggaaagcgaaaggttgtggtggctaccaatgtcgccgagacatcgatcaccattgacgacattattgcggtaattgatagcggcaaggtgaaggagactagctttgacgcacaaaacaacatgagaaaactcgaggagacttgggcatcacgggctgcttgtaagcaacggcgaggacgagccggtcgtgtacaagagggcaggtgctacaaactctacactcagaacctggagcaaaaccacatggcagagcgaccagagccggaaatcaggcgggtgcctctagagcagctttgcctttcagtgcgtgccatgggtatgaaggacgtttctggcttcctcaggcggtctcccacacctcccgatactcctgcaattgagggggccctgaaactccttcaaagaatgggggctctcgatggagacgagctgacatcaatgggtcagcaacttgctatgctaccggccgacttgcggtgtggaaaattgatggtgtttggcgccatctttggatgtcttgacgactgcgtcgtaattgcagcaatactaagcacaagaagcccattcctttcgccttcagacaaacgagaggaggctaaggaggcaaggatgaggttctatgatggtgacggtgacctcgtcactgatttggaggcattcagggaatgggacgccatgatgcaagatcgactaccgcagcggcaagtcaggtctttctgcgaggagaactttttgtcgtacaataccttgtctgatattgcaaacacccgcacccagtactatgcagctcttgttgagattgggatcgtacctccttcagcagccacggccgaaacgcattcgaccggttcgaggagctctcagttactacgggcactcatcgcctcagccttcaccccccagattgcacgcatccagtatccagacaagaagtttgcaaactcggtgtctggtgcggtcgaactcgatccagaggcgagatcgatcaagtttttcaaccaggagaatggccgcgtcttcgtgcatccgagcagcacgctgtttgggagccagagtttcgcggggagtgcgtcatacatgtcctactttagtatcatttccacaagcaaggtctttattagggacctgactcgtaagttatttttttatttttttacttgtaaccattcacccttgtcgatagatgaccactgactagtgtttatccaaacagcattcaacgtctttaccctactactcttctccggccctatagagctggacactctgggccggggtctgattgtggatgggtggctgaggctcagaggctgggctcgaatcggagtgctcgtggctcggctgagaggattggtggatgatttaatcgcggagaaggtcgccaaaccaagcgttgaacttgataatagcgaggtgatttgcttggtgaggaagctgattgagcttgatggcatggatgcatgatcggattatatgacgatagacacgaccgacacaaaagaccacgatagatggggcggggcaggagtctacagagtatttataggtattatgttaaaacaagattattctggccatccaacctacaacatctctctcgaagaacctgatacaaaaggttaatcatgtttgctgcctatcaaatttataccaggctgctgtgagtcaagagccgtggtggggcagccccaaactgacttctacctcccacttattaggcagacagcaggctccaacttacaccctgctcgtctctaccaaccttgcactccttggctggtgttattctctggcagcgaacgcatgatgggctcaccaggctccgactcggacgaagcaatcaccagggatgagatccagggtgttgaacctccacaaaccaagggcagccgaagcaaaaatgcatgtatgtagctgcccgtcatcaccaccaatccatcgtccgactcacctgctcactgaaagccaaaagtcacagagctcatgagacccaagcccaaagctgctcctgcacaggaccacagcccctccagcttttccagaggcggccacccgttcaaggaccgcatgggcctgggcgcctacctggccgacccgtcgtccttcccgtcatcgcgggtcatctaccacaccccggactttgtcgtcatcaacgacctgttccccaagtccaccatccacaccctcctgctcccgcgctccccaaaacacaacctcatgcacccgttcgacgccctcgaggacgccgacttcagggccaaggtcgtcgccgagacggggaggctcaaggtcctcgtggccagcgagctgcgccggcgcctcggccacaacagcagggcggacgcggcgaggcaggcggtcctggacggcgacgactttgaccagggcgtggagctcgacccggccgacggcctgccccgcggccgcgactggtcgagggaggtcatcgtcggcgtccacgccaagccgagcatgtcccacctgcacgtccacgtcctgtcgcgcgacatgcactcgcccaaggtcaagcaccgcaagcactacaactccttcaacacgcccttcctcgtcgacgtggccgacttcccgctgggcctggacgacccgaggaggcagaccaaggaggccgggtatctgcacagggacctgcggtgctggaggtgtgggcggaatttcgggaaccgcttcaagcagctcaaggaccatctggaagaggaatttgacgagtggagtcaggaatagcgtgagccagtgattccaattttcacgcggctgaataaagctgcatcccgaagtcttcgctgataagaatgggtgtacgcgggggacaactaggaagcataaaaacagacgactgctctgcccgaagctctgctgctctcgttccggctgccagcctgcctgcccacagcacccttatattcttgtttggggacctgggagccataccagcattaaaaacagaattccattattatgataaagcgcccacccggccgccttggctataactcctagctatcctgatacccacgcggtgtttgtccgtcaaaaaccctcccttggctacatgttcgagcccagtaatcgatacagaatgcagggaaaggacgtgtttcatttctgttctgagtttactgcaacgataaagaaaaaagatttcgatcaacccgaccactcgtcattgtgctggtttactcgctgatttcttcagcgtcctattatatgtgagccgttagtcttggtatttaaagtctccaaagggggaaggaaagggtggactaacatcattggcctcgtcttcaatctgcttgtttgctggaaagccgatgacgttagctgcgcgcgccttcaaacgagtcgagtatcagaggtaggggaggggggttgcgtaccttcgttctcttcatcatgctcctcgtcagccttgtcctcttcctcttcttcttcctcttcctcagctgccttagatgctctcctccccttcttagtcgcggacttaggggttgttgcgacgccagcgtctgcgtccgacttgcgaggtcgtccgcgggaacggccaggcaccttgggggttgctggtttagcagctgctttgacagcgcgcttggcggcagcggccggcttgccgcttcccttggggcgaccgcgggggcgcccagtgggcacgtatgcgggcttgggcttgggggggcctgaggtgccgtcctttcgaggacgaccacggccacgcgctggggttccctcgggcttggtaacgcctccagcggctccgcgagatccgcggcctgaggtggctgtgttgtcctccttgggagaagctgctggctttgtctttgccatcgttattggaggtgaatattaagaatgtcgatggtttttcggtatatgctggtcgcggttctggcgctgaaccttggcttggaagctggatccacgatgcgacaggtttgaaacgtgcgatacacgagaaattcggcgtgcccaaaattgatgcagaatgagggacgaacgaacgaacgaggcttcagggaaggaaataagagaatcgggggcgtgctcgttgaggaaaaaaatccggaggaaaaagaaacgcgtttcgacctgcggttgagattgcaggtaaggataaggctagcacgacgcgttcgggtcacgctctggcagtgcgctaaatcgcagaggggacgggatcgagccgacgctctgcaggcgctaaattacagggacctgcagtataaattcagcatggaagcgggggccgagccgcacatcatcaattcttggactcggcctcgagcacagtccttccctaaccggctgcatgcatctggcaacgcggtcgcaatttgaaacaacctgttactctcctgcagcagtaatctacttgctcgatcaattgtctggatccttgttgtttgcgaaaccataaggctctgatgcctttcatgattcccactcgtcgccagctggtttgcagagcttgcgccttgaggaacgccagccccaatacctcgattttattatatgtgaagcgttaaagaaccacagtctgcaggtctccctgccaagacacttttgattcttgcgcggaacgaaacgagtaggcgacattagaggtgagaccgaaatttgaaggctttccacacatctcatcatactggtagaaagtccaaagtcaattccgaatcatcaaatccatacaaatcatttgaagaaacacaggaaatatttgtctttctattcgcttgaggccaacaccaatacctggaacaccagtatagaggaacaaaagcgcggccttgcctcatctccaataccacccaccacctacacaacaagcttgatccatgcagcactaagagtgtcttacctcaatcggctttaagtaaacaaagtggtgccatcagcagcgcctggccatcacacgatgcgcgcgaaggaggggtcaatctgatgtacgttagtggcagaagggatgttttaaacctggggatcgatctaatgtctgtcccgccagacgtcgctcttcttccgcttcattctgaactgacgagcgctacatcgcagtcaacaggcgtcgtctccatccagttaccaggccccctgctgcagcggataagctctggaattgaatcgcccagcgacccagattccgcccacgccaactggccggggccccagcacaggccgcccaacagcagccaagcgcacccaaccagcctgtcgctacctaacctacaggctacgtgcccactacctacccgactgctaggcccatctggttgaccctagcaaccagcccatctcccaactaggcaagcagcataaacaagaaaagtggacgggaggaagtcggcctttgaaatgtggcacattcttcgtcaacgctgccagaatactatcgagcaagtcaattacacactccgggacatggccctcgactctagactcatgccttcctcgcccgatccccagcgtgttgtgcgctcctctgcctcaaccccttctctgcgctcgcgcgatgggactgttcccatgctctccagaatggacggcggaggcaatgtgcgagtcgtggtccgcgtgcgagctttcctccagagaggtgagtgggagcttctactctctctgtgaagtttagagaaggttgttactgacacacgtcggcacagagctcgccaagcagactcgctgcctgatagacatggacccaatcacccagcagacgactctccttccaccagacgatccggacgctgccagcggagggaaacaacttcagccaaagtcacgcaaggtctatgaggagaagaacttcacgttcgacaactcgttctggagtcatgacccaacagacaagcactatgccacacaatcagacgtctacaacagcttgggagaagagtttctcgatcacaatttcgaaggataccatacttgcatattcgcttacggacagacaggatccgggaagagttataccatgatgggcacgccggaccaacctggcctgattcctcgaacgtgcgaggatctgtttgagcgcattgatgcagcacacgccgaagacaccaacatcgcctacagcgtgcgtgtgtcctatttcgaggtgtacaacgagcatgtgcgagatctcctcgtgcgctccgaccccaacaaacctcccaactatctcaaaattcgagagtctccaaccgaaggcccgtacgtcaaggatctaacagaggttcccgtccggaacatcgatgagatcttgcggtacatgaccaacggtgacgcatcaagaacagtggccagcaccaagatgaacgacactagtagccgaagtcacgccgtctttaccatcatgctcaagcagattcaccacgacatggaaactgacgagacaaccgagagaagctcgagaatacgactggtggatctcgcgggtagcgagagagccaagtcaactgaggccacaggtgcccggctgcgagagggcagcaacatcaacaagtcactcaccacgctgggtcgtgtgattgccgccttggcagatccaaaggcgctgcgggcgggcaagaggaaagacgtcgtgccgtaccgtgattctatcctgacctggctgctcaaggactcgctgggaggcaacagcaagactgccatgattgcttgcattgcgccgtccgactatgacgagacgttatcaacactccggtatgccgaccaggccaagagaatccggactcgtgctgttgtcaaccaggaccacatttccactgccgagagggacgcccagatcgcagcaatggcagaggagatccgcctgcttcagctctccgtctccgactcgcggcagaaagagaagaatgctcaacaagccgaggagagactggaggaataccagaaccgcgtggctgcaatgcagcgaaaaatggaggaacgtagcatggtggccgagagcaagatcaagaagctccagaccgagaacgaagctctcaaactgcacctcaagctcgccatcgacagtctcaagaaccccatcccaccagtcaccgtcaagagcatcgacgaaggtgtggacaacaaggagaatgtagacgcagacgacatatccgaggccgatgactatgagtacgactatgactcggagagtactgcatacggcgaggacgacctgcaggaagacatgagacgctatctgacggacatgggcaacctgcggaaactgatcgggggagacatgatgcgcttcaaggacgaggagagcgccaggatgcctctcggggcgcgcgagaatatctgagccaagagctctctctttgatggaaagcatggtgtttgggagtgaatatcacgacaggaaatattgttcattcacactttggttcatgtcttgtttgtttctttttgtcaagccataggagtttgtctacttttggtaaagatagtgccaacataaattgattcaactatacaacatcaacgacgacctcaccatgagagattgtgcttcttttcctcgttttggacagctttgtcgtagttggttttgcctccgaccaaccgccccacctataaccacatcttctacattgatgtccaaaccagagcttcagcaggcccttcacaagttataacttacacacattacatggcaatgtcgcttgaagcgccaaagccttaactttaggattcattctccttcacctacttggatgatacacctgtaaagcaatatcaattgacggcgagccctgcgaggtcctccaccgcaaacgacctccaactcgctcgccaaagaaatccaatacgcacatcacagcttcatccatcgcaaacccccaaacaatgcccgcccgagtcccctccgcaaaggacttcgagtccctcgcctccaccctcccccactccctccacttcccctcgcccccggagtccaccacctccatcctcatcctcctccacggcctcggcgacacggacgcctccttcgcctccttcgcccgcggcatgaacctccccggcgtcctcgccatctccgtccgcggcacctccccgctccccgccggtttactccccggccccggctccgcccagggcttccactggggcgacgacctgctcatggacgagggccggggcgagctggacgctgatcccggcttcgcgcgcgcgcgggacctcgtgctgggcgagctggtgcgcggggtgctggtcgggaagctggggtgggagatgagcgacgtcatgttcttcgggttcgggcagggcggttccctggccctgggtctggcgtctcagctgcgcgtgcagccaaaggtcgtggaggtctgggatggcggttcagattcagcaaacttgggcggggaggcttgcaaaggcgccgtgtccatcggcggtcccttgccctactctatgattccgaccgtcagtagtcggaagaagagcaagtcaaaggttcttgctgtgcagctatccgacgacaatatcgatacgataaagaaggagtttgaggatgtcagggtcgtacagtggaagaggagggaagttgacatgcctaggaatagggaggaaatgttccctatcatgaagttctttgctgaccaaatgagaagctggggatagacaaagttcttcatatcaagacctttacaaagcaaaaaagtaataaatatcatgggtatcatattttgcgactcctatattatatcgtgtctcatctcgaattgcccatctgaagcatctctgccagtgtgtcccatttcgctgattgagagtcacccttcgccctggccacactccgcagaccttctgttataaaccgtaagtgtctctcaaaatccttctgtatctcgctcagcgcttccaaggtcgtattccctgcatatgattgctccagcttgatcgctaggtccataatatcagacatgcattccctgattggttcaagccgagccccaaggcaaacaccatcgacaatattcttcataaacgtatcgtgcacgatgatgagggcgtctacatcttgagcttcccggagtttctgtcgcatttccaagaggtgaggtgtgaggaccagtgtcgatatgtagttttgcattgtattacaaaaccacaatatcctagttcggcatgagtagtataatgctcgtgcctcccagtcctcgtggtctgtccagtaatagtccaaaatcttaggtttgtgcagctcatacgcagctcttttgaactgaagaaggagagagaagatcttctgataattctccatactcgttgatgacagaatcatttgtaccggccacgtgaggcgatagtcaatcttaacatgtggaagtacagatcgtacagagtcccttacggaagtaggagtttcatccattcccagcttatcaacaatgacagttaaacggtccgcgtctagcaaagccccgaaagcttcctgagcaatcgctgtcaagaaatatcgacttctccatgagggatcaagagaattcatcttggcgaatatggcctcgtggaagatagtcgaggcagatccatctgacatgaaataaagtctctccagtgaatctaggttggaaaacagcgcgcactgttcaaaaagggccgccttgagcgttgtcgatgtcgagcgatatttgctttgaatccagcgctcaaaagcagcagcgaagagatctggaaacggcgcgaattcaaacccagctggacaaatagagtcgtaatccagaggcggctcttcttcctccacgtgacgtagaatggattgatactccagacgcttcaagaccacgatattttttcccgcattcataattttgctcgcggctggttggaggaacacaggcgcatgaagacctccgtccacaccggtacggaacttgaatcgatcactccagatacgaccaagagccaattccgccgatgtttcgtatatgaagaacgagccaccagtctgcagtttgccttcatccatccatagcctaatcggtcttagatagacgttgaagcattctacaaagacccgtgcaagagatacatatatcagtttatcttcactcgattgagccagtgttgcgccttggtatagcaattcaagatgacgaaaagctccggagtcagaggtgtcgttcattccggtaacaacgtctgccaacgcatacaacggtcgtagccacggagttagttctgtcttcaaagccatcaggctaacaatttcgtctttcttggggcacgcaaggcgggcgtgtatttctgacaatttttggtcaaagtcgagcaaatgacttccgatggaatcttgaaatgcttgtacatgggccaaaccttgacttttcttcatgaatttcctaagaggggcaagacgccggccaaactcagcaaaagtgttgattaacgccctgtgtgtatcccacgcaatgtgcgatatttgaaaagagggtactgggacaatgttgcgatcaaagagagtggtgtcaaggccttgaagcatgaacagaacttcacgaagaacatgtgcttcgctgacaccgactttgcgtatcctccccgatgcgtctgttgcaggtttggcagtgcgccaactttgagactctcgtactgagttgaagagcgactcgtcttctgggtggactattttggttccagtattcctaattggcccctcagcttcacttgaatcagtttcagataatgaatccgagccatctgcggtgttggcatatgataactcctcatctgagctgtcactatatttgatcgatttccaaagctcagcgtcttgatcccagccatcttctttggcaatcgcctcccagcgcaatgcgggggcatcgtcttcctcagactgccgtagcagttcaaggtcagtgagctcagtgttgaaagttggttggtcagagagctcaagaagtaagaagaggatttcaggatgccatttagttgaaacaccttgaagcttttccagcctctcgtgaagattatccgccagatcatctcggttattcacccggaagcgctcttcaagaccatccaaggtgttggcgacgtcaaattgatttgtgcgtaaaaatggatgcgatctaagtttccgtagaaccacatcacgatgatgcttatgcctctcagggtgtctctaacacgaatcgtcagctgcttctagggcctacccagcttacaagaattggaatctcgcacctgagaggatacgtgggttacggcttcaacaagctcgctagtgagcggcccaagtcgagttgcaaaggccatcgtcgtggcacgtcttccaccaaatagttgtttccgttgtcgtagtgaatcaggctctgcggaactagcatcatcatttcgtttctttttttgttttctttttttctttacaagtgtaaatgcctaatcctggacaaagcaggtaaacagtggtttatagatcgttcagtcgtagatatggcagaccgtttgaatatgagaagaattcatataatcagaatgcctacaaaagatgcatctcggagcttgcatgtgtcgctccttccactgccaggcggatcaagctcatgcgcggcaagatggtatcatgcaaaggcaggtgcgatgcagccgagcggtggacgcgtctgctggcaggagcaagggcctgagcttgagcggagttttccctcccttacgtacgctggggaaccgtgataagcttttgctccacttttcgcgccaaggccgccacagtgattggtgtgcgagcggtgacatcaggagtcttgcgtatcgaattcgaaacccctgatagccccgaaattatggacatcgccatgtttccaacggcccatctttccccctaacgcattttactttcttcaaaacgtcaaacggccatcatctgtctgatgcgcttttcatgaggacgcaagagccatgctgtagcgcttcttgacgtcttttcccttttattgttcgcatgctagtcatctttcttcatcaatgtccaattgagactttgacagtccaccacaggcatacaccagctagccggcaccagccatggcgttagcacggcccgtaagggcaatgatcgtgttcgccgtcattctctggtgctttgtcgtatttcagatcttcaagcccatgcctgagaggcatggccccggcgaccgatatctcaacttcgagcgagatcccaacctcgaccgtgagccattcgaaccagcgaccagcatcgcacacgtgcccaagacaatcgctaacatattccatttctagcaacgggcgaaccggaaggcatcctcacgcgcgcctctgagaaatatcatcccaatgcgaagaatacagatcgaatcgatgccacattgctggccttggtaagaaacgaggaagtggatgacatggtgtcctcgatgatcgatctcgaaagaacctggaacaaaaagttcaactacccatggactttcttcaacgacaaaccattcacagaggagtttaagaagaagacatcggctgtgaccaatgccaagacctactacggtgcgttgatctagatatcaggcccttgctcttattaactttctccacagaggttatcccagatgagcattgggacaagccagcatggattgacgaccagatattcgccgagtcggcaaaggttcttgaggagaatggcgtgcagtacgcgagcatgatgtcctaccacaagatgtgtcgatggaacagcggtctcttctacaagcaccccgccctaaagaacacacgctactactggcgtgttgaacccaaggtgcacttcttttgtgacattgagtatgatgtcttccgttacatgcacgacaataataaaacctacggattcaccatcaacttgtacgacgaccccaagactctgccaactctatggccagaaacggtcaaattcttggcagagcatccggactatctccacgagaacagtgctatgaagtggcttaccgatgatgtccaccgtcctgaccacaaccgccaggctcagggatactctacatgccacttttggagcaactttgaggttgccgatatggaattttggcgaagccaggcgtacgaggactacttcaaccatctcgatcgtgctggaggcttcttttatgagcgatggggcgacgcgcctgttcacagcattgctcttggaatgctcgaagatgcaaacaagcttcattggtaagaccacgacgctatgaggagcaagtgaagatagttactaacaatgttgtcgcaggttccgtgatattgggtatcaacatattcccttcttcaactgcccgaactcgaacaaatgtaaaggctgcgttactggccgctttactgatggcgaagcctggctccatcgcgaggattgcagaccttcatatttccaacatgttggcatgagctaaacgacgaaacgcctgaattttggacacaatcattattggggggagagatattgatgttcttcgtgcatgtatttttatctgctaattagctcagaggcatgggatcatggattgtcggggtcgaaatactcccaaatcggcaaccttgggccatgtgtcttgtcgtttctcagccattggcaagtggtgtttcaggcgccggccggccttcatcaatacacgggtaatggtaggaattatgatgtatatgggtgtatagaacaactctttttggatgaaaatacgagattggaaaccccttcgacatagcatagaggcgtggttttgaattatgattgattctattcatagcgctccaaaaactgtaaccacccccgaagtgcctccaacacagaattgatccccccatccattattcctccaagccatgcagctcacgacattgcttctgaccttctctttcccatctctccccaccacctttttccgctggtctggcccgcccggcccccacggcaccctcacctcggcgaccagacggccgttgagcaggtcccatgcccaaatccttccctcgccatctgggggcgattcgtcgcccgcaagaacgtacttctcaccaccccctaatatcgactgcaccctcaggtcggtgttcttaaacctcgggtccgagtaagcccgaaggcactccccagagtcacgatccatcaacctcagcttactgtccagcgtccccgtgagcatcgccctcccatccctcgtcagatccaggctcgtgacgctggcccccagcacgtccgtggtgcacctccccatccgcacgtcgtagctcctcaccctcccgtccacgctgcccgcgacgacctcgggcccccgcacggccaggcacgtcacggcgtcgcgcgcctcctcgagcacctgcacgggcttcgggttggtgctcctcgcgtcccacagccgcaccgtcgtgtcgaagccgccgctggcgacgagcgagccgccctcgcccgccatcctgacgcagttgacccgcgaggagtggccccccggggcggacccgccgaagcgccgggtcgtcttggccgtggccacgtcccagaggaagacggcgcggtcgcctccggagctgacgaagcgctcgttgtcggcggcgacgtcgaggctgaggacctcgtacccgtgggcctggtaggtttggatcaggcgcccgtgggggacgtcgggttttgggagggggtggacggaggggatagtggtgctggggaaggggttgtacaggcggatggtcctgtctgacgacccggtgaggatgtaggttccaggcgacgctgagtacgcgactgcgtggattgggcctgtggctcgggtcagttgtctattcggagtttgctgtaagtgaagcaagggggagggcacgtagaaacttggagttgagacggaccatttgcgcccaggaggagggcagctggctgtgttggaaacgccattaaattagatggagtgaggcgcccatctcatccagtgcaggcttccttgtaagttgcccagttgatagaatgagaaattgacgtgtctgatgaactggatgttctgattgttctggcttgaaagcagatgaacgagaagagaatgcattggtcattcattggctgacgctctaggtgacccactttgtcgtggtctcaatcaacctgccagacaagcaggaactagagtcacttcgataaactaattatggtaatcaaatacctcctattgtataatcataccaatactttctgcaaatcactgaaaagtacgcatatttttaatctattgtctacaagtgttgtggcctatatgacaaagttggtcaggaaacacctttgtggtctccgttattctaaccacttaccgactatacctagactcaaaaaacatgtcaaaaaggtatcgggtctatgagatttattccggttattctaaattctataggacaaaagcctatttaaaggttcttagaattctcacatcactaattgatgacagtgagcttcgaaatgggagggtcgtcttctacgagcttcacgagcacagatcagagcggtctacgaaatcatatttcaagaaacaagaatcaatgcggtcaaacaatatatttggggcgttgcagccccgagatctttagatctctgctaattcccaatcgcatagctaaaataacaacaacaaagagtcatctgatcccgatgaccagtggtatcaatcccggaacgcctaactgtcaaagatgctgatgagccaccccagtttacgcagcgcgcgcacaaaacatatatataagagagagaaaaaagactaaaatgatgtatggcaaagatatgtagatgaaagacgtaaacttcaatgtatatgcaagaaacaggaaaattgttcgtaaagtcctttttccccttctcaaggggaaaattagtgcagacccaagtagatgacatccatgtcagctgcaaaggtcctgcccagaggctcggtgaactcccagtggagctccttgtcctcgctcttgccccagggcttggaagtgagaacgtagccctcggccgggctgactggctggggcccacgctcgaagatcctgttgaggaggtaggtcctcctctcgatggcgtgctggatgttgcgcgagtcgtcccagatgttggccatgttgtcaatggggggtcgcacgcggcggatgttgtcaatgaccttcttggcaagggagaggggctggctcgcggagagcacgtccacggcctcggcgacggcaatggcaagcatgggcggcgggacgctcatgttggtagcgcgcgatctgaagaggccgtcgatgctgtcaaccatgtcgatggtgtcagcggcatgctcctggcatgcgcgcacgtggtggaatcgcgcctcgctcgacagctggcggggagcacggctgtggcggttcagcttgatcatggcatggtggtagaggaggtgcatcgaggcaaaggggcccatgttaccctcggtggcagccgcctccaggttcgagcggttcagtgacagtctggttggtagagtagactgccacgactcaattgatcccagcaagcctcgtaccttactgaactcaccctcggcagatgctggccggtgaaccagtctgtacacagtggcctgactctcagcccaaaggtggaccatcatcaccaagtatgtggcgatctcatcagagtggttagacatctttgaaaggctgagcgagtaagggttgaagactggggcgagactctcaacctgctcctcaaagctgcggcgatcacaaggaagacggatgtagatgtcatcagggttgatcatcgtgacgcgatcagggaacatgccgctcagccgctcgagcatgaatagagaccaaatagttcgcctccttgcctcgcagtagccagctcggttgagacccatgggaaacgacgagatggaggcctcgttggagttgtccagctcgaggttcagctgcagggaggcgacagttgccgcggccgcagacatgagttcgttagcctcacgctttcggccgacggaaacatagtagagagcaagaaggactcggctctgggcgagctgcaggcagttgaactgtgtccccttctgcgcgtactgggccacctgtgcgtactcgaacgcaatgtgcttggggcctccggacaaggcaactcccactgccaagatgctgtacaggagcatcagatcctcgggcaacttccgccgtgtcgggtcggtaacccacgccctggtggatcgctcggggagcagtgtcaagaccatggtgccatcgacatgtgaaaagaactgcgagacaacagccttgatagactgggggtcagtgacgaaggggtctgtctgccaggctcggtgcaagacgtcgtcggggatgcggggcatggccggtgttggcgtcgggataggcgaagcgatgtgagatctggatcggtggaagggcatagagttggaaggcggcgagtctcgacttggcacatatgtctgctgatcaactttcaatcgcttgttggatcccgcatcggcggaagatgggcggtactgagcacggggggagactggagagaccgatcggcggccaaaatcctcggcggacactcgtcgagaaccgccaccggttcgaacatcgtcgagttcggctggtggtgtagatggagaagtattgtgaccacctcgcggacttgatttcattgagttagcataaagggtttcacactcccacgtcagtcaagtcagggtgggttttcaacactcacgcgttcttgaatctgcagactcggccaaacttttcgcactgaatgcaccgggggtagtcggggtcgcacttgatcttcttctcacggcaagtgacacaagcaattgccagcctctttcttggcttaccagccttggtcacaccccagtggggggtgacagcctcgccatcgataatagtcttgcagtgagttccatcgtcgtagaaatagcaaaggccttcgcctggcacctcggcggccttgacgaatctcggcaagaaatgcgtccctgtccagatcttcggtccaagagtgctcttcgtcgaggacccatcagcttgcgacgtgctgttggcagtggatggcgggttggcagcggtggaagaaggcatcccatgctccctgaagccgctgccggcctccttttgtcctgtaaactgcaggcggaagtggtcttgagagggctgcatcgtgcggcttcgaccaaattcgcccctccccgcctcagcgtccaaccggctctcctgtgcgttagttgggcgaaaccttggtgatccaggcccggaggccgatcgtctcagtccttggaatccgggcttctccgcattgccatcatacgaagttcgtgggtgtgataaaggtggtgagagcgtgggtgggaagtaagaatcacttcgcccagcagagacatgtcgagggcggtccattcttggtgacgaggttgcgagagagctgtgtctatctgaatggggcgagttcagaggacgaggagctggaggaggaggtccgaagatactgcttaatgagggaagctgctgctgtggcttctgttgtccggcgcccaggttgtcagccagcttggggcttgtctctgaagccttctcgctaaccatcgtgctgctgctgctgctgctgctgctgctggggttcttgtcgtaatcctgcatcgggggtgacgatatggagcgggagctccaggcaacttctgtagctggggacgatctcgatgagaaaactgtggttgttgggctcaccagagcaggtggtgtgtctggaggaagcagacgctggccagattcgaaggcagctaacccacccattgagatagctttaccttgtgtgattttttagggattatgggaaattcaagtgtgccgtaggaagcccacaggcatggcccgaacgagtgttttcctcccaatcaatgtgatcaacacgtagatgttcttgtaatagtttagtagcggctgatggttcggtatcctaaatacggccaaacaaacaccctcagatgagtgttatgcgtgtggtatgtacttgcgaggaggttcgtatatgttccaaagctgtataaaagaagagagaaaacagaagcgaaggaagccaacaagcacgtatggaaatatgaatggaagaatggagaggatcgagaggcaagcaggctggggtagtggctactatgtaggtgtaggtaggggccacaaggcttcataagataggactacagcaaccaagtggattcagggccaggcaggcgggttggatctagagaaggcttggcctcgaaaatatgacacgagaaatcgggggttgtgtggttcggaatgcgaggccgagagagatattagattgaggacggccaccatgcgacttggactggatccatgatccatccccggtacgttgacccttctccttctgcgggatgtgccaaagtactatgtaaagggcaccagattaaggcacggtcaaaaagacctggtacatacgtaagaggtgcaggaggaggcgcaatgacaatgacagggagcgcaccaggcccaacagcagacgtcttttcagctggggctggactggagaatggcgactacgcgatagggcaaaggcgccgggtgggagagcaataccgctacgacgacgactaacgttagtaggtccctaccgtcgagagctccaggcaattagaaggtacttgccgggcgatgccagcttcagccaaccagctaggctctcgtctccaaaataagcggcttcacagggcaggggcccttgcagaccggagtttgggggaggagacttgcccagggcataagctaccagagcagcagcgtttgcgccggtcgggatccatctagggctccatgccgagagacgttgctattcatgattctggggcaaagtccgtttaatgacacgtgcgcttggctacatatgtacatggtgtggtctggtatgtggtgtgtggtgtgtatccggagatggtgtggcgtgtgccacgatgtcgacgctcccctctacttggcacactcgtccaaggaaagggatgtccctgtgggcctgggagcagtgccgccgctcccaggaccaggcatgaatgtaagtcgacgggatttgggagcatgggcaagggcatggcaggctggtggctccaaagggcaagatgtgtagcattcgtcgcaagatccatccgacacagagcaacaacgatgcgaaggaggtctaggaagacaatgctcttcgttggggtcctggctcacactgcatcgcagctggcgtatgcgctatgcatgtactaccagagtcgttcgaacgcagatcggtttgaggcggctctgtagcacaaagctgctgagagacatcgttagaatgggcctttagtctccaatcggagcatcagtgtcctgtagccactcaaagaaaagacactatggccgatggtaataatagcgtggcgttggtgaggtaggggcaaatatgccgttggtaggccgggctggccctaacgatgaccaacaccaacaccaacaccaccactaccaccaccttcagctcaggcctcgcaacggctatcgctgtttgacttgcacgccgggactttgacaaatgtgctgctaacttgggtactctcgtaaatgtggcacctccacaagcccaagctccgatgcctgcaacaggccccatcacccatgcaagggagagagggaggggcgttgggatagcagccaacaagacggtggaagaagcagagaagcaatcatcaggctctccatgcgcgcagagctggaccttctgggaaacgccaaccaaccggccaaccaacacacgatcgggcccgtcttaccgttccgaatcgtcgagttcaggaatcgcaaaagtgcttctttttgcgtgcttgctgtgcctcaccacaggccccagaagccaattgctgctagttcatatacccgagagcgtatgctaaaccaaagggccagtaagtaatcattacaggtaatcctacgacatcctgccttccccctccgcccagggcagcccggtcctgtcctcagggaaccgtccggccgtggaggttggctcgcttcgcccggctgagagatagatagactggttgtttgtttgtttgtttgtttgtttgtttgctggccggtacatttgctcctgtggttacgtaggtacgagccgtcgaagcagcaattggcatcggcgatttactgagtaggttttgggctaagtggttgatcttgttggccactgcggcagtagcaactcactacaatcagcggtggggatgttcggattgggccaagtccgaggcccggccggggcggacagcagacgactccgtgcgtgtccatccagccagcagccatcgcacgaagagtacgcttctgggcatctgcggtcagataagcatatataaaagttgccagagtgggaagtattcagcacagattaatgttgcgaacccagtcctgaggttggccgtctgactggccgccccacgtaatcatgatggcaaactgctgggcttttggtaaggcagtgagcgaggtgtggcttccagtcccgaacacctggcagggccgacccagggccaggcagggcagggaaggagccaagcaaaacctcctcaagaggcaaatcgcacatggcgggcacgcacagccaaaaacaaaagcacttctgctcgatccagcggtgcgctaccatccatggcaaccaaagtcccaaacgccgcctgtgccatcccaatgccaggccgtccgctgtgcatgcgatggctgctgggttcgtcatgtctttgtcacgacggccagggtcgctctaacagctgagacacgacacgacccctgcatgtactacgtcgcctacgacggagtttgcgatgcgctcggcacatcgaatttgggacatgccctgcgtatacgctaatcagtggaggtcggcatattgcccactctcccgggacccccctgagcctcgatttaccaccagtagcattgtccatctgcccgaggcggccgaccctgcaccagctccagcaggcctgcctccacgcgcgcggactttggactttcccatgacatggagcataacttcttacctgcctgagcagccgagcgcgaaggcggcatcttccccgcttggctacccgccgcctcaccaagccataccgggccatctatacggtacgtcgccgtatggaatcccatcatggcaacagccctgcagatgagccactcaatctgtactaataacccgagtcctgtattttactgctcctaggaaccggctgatatcacatggcatctaccaacgtccagctaggctacgctgcgcaggtcatgcatgacccaagtacctaccctcgcttcaccgccggcgtatgactgttgctctctcgaggcataatcagcgaaagaataggtatcagtcagggttattcatcgatcaatcatcatcccttcatttactattcacccgaaaaagacccctcccgagcgcgcggcgcaaaaccctgccagtgcccaaggcgcgcacggggggctcgcatcgcaaaggatgacaggcgaccgcccaaacgagccacattcggggcaaagatctaaacctaatgtcaaaaaataacaaaggtagtccactgtggcgggctttgacatgatcagggcacctttccaggggtcgccagagatccccgtcagatctttttagcggccaagaccagaattagccgtcacgtcggtatcgtcccttgtttgagtgcagctgattggcccactcgtgtaagtcagtcccgctcatgcccatcgtttcttctgttttaagaaaatgatatccgagtgagtgcttcagattgggcggctttggttggtctaaaaacaacacccgtctcagatcccagaaacgccgcccatggtcatcagcaccagcgccagcctcgcagccagaacccaaattcgctccgagatgagaatcccttcctgaatcaatttccgcgagttccagagatattgcaaggctgcgaacggctacaacttagaccgccttagcctcgtccgccgcaagaatggtccatccattcaatggggagctgaaacacaagaattccacaataagaggtgccctcttggcacccgctttaagaaaatcgacccgagccacatttacggcttacacctacgggatgtggtgcaatgcctccacatccaacggcatgtcatcatgtcccgctcgtcacacacattgcatggaatgagaaaaagccataagccggtgaattggtcgcatatacgggcagcaatttgcatcttcaaggatcgatgaccacacccaggcgatccgatttgatgatgatttgtaaagtagcgccgcttcagggcaaattacagagagctcccctctgtggtcgcatttcagacggatgagcatgcagcaggtaccggattggctgcatgccatattgcgcacatcaaccaacagtgccgatatcctatgaccatgcccatctgaccacgccagagagaaaggggaaagcttggtggcagccctaagagaaatgagaggatgtgtcatgtcttcaaaagggcatgggtttaaagaaaacgaaaacaaaaataacgttcgccacaagttggctctcatgtgtcccaattcatagcaacgagagctgacgagcctgtgctctggttccccagattgggtctgaggagtttcggccgaaggtcaacgtcgcggcacaccaggggcctactacagcacgaacggcatattctttgtggtctgtcctctccttcttctttctcactcccggtggctgtctgggagctggcacgccccgactgggaccaggtatcaaatcaatgcacacagctctctgccttgccgtgcgcgctcccctttactggggcccatggcgtgtgccaaggagacctgggaaaatccccataagcgaataggcccggcacatcttgaccaagatggcgattgccgttgtggatgacttataaacattggtgctaaaagactagccaacgactaggttcgcactccatcccacgaaccggctagcgcgcgcgccgctggcagatacggcgcgccatggaatatccgaaggggctcaggctgccaggtgtgaaacggaagatgccgtctgaacgtcggatccagacaccactaccggcggtccaagactgtcgctgggccgatgacagagcatcaccgtgtcccgtcgatgcgtgaccgtccacaccacctctcttgggctcggggctaatataactaacgtgcatagacgcctgccctcaaagcagcaggaaacagcttgtgggtgacgacggcagatcaggaggcgtgtggcattgggtgcacccggcagccgtcagccatgcttttcgacgggccacctcccgggtgctgggcggaatctggagcacggcagtcacaggttaccttcccacctgcgggtcctgaacacgtactcttaacccagcacagcacatatgccaggccaggccatgccatgccaggctcaatttgcgcccacgggcttgcaggaatcgcacccgcacccccaaacaccctttctcagtggtgcagttgcgagattctgccaccagggtgggaccctccgggagtggggtaattaaagtaggtcgcgtggctaatgaagccccctttgccatgaacttggctcgtcagcgccacagaaaaggacttcagtaatagcgtcccaggaaggcgagtccagctcgacggtagcgcacacaactcggtcccgagcggaagagtgccgttgctggctcttggctcgatctgcggtgccaacggtttgaagcgccgtgatgctagtggccctctagtgagttgctgtctggattacgcactgccgctcggttattcctcatcaggctaggccggagccccaagaatgcaaattccgcattctgccaactgaggaattcgcatgtgcttgggcttagctcgtgggatataacacggctgagctgcgtcgtatagcgggttggccccttgtgcttgccatgttgcgagcagcgggaatcatggcccgattcatatcccgtcacgaaccaaaacctcagctcgtcatcatcacagtcactttcccctcctagccccaatgatagtgcaacaatgtgattgtcgagacccccaatgcggtgctatgacgcgcggctgttgaaatcgggtggacggggtggagagcgtatgggtacctatcatcaatcaactcatgttagtttcaggagcctctcgctcaatgaaccaaccactccccagatattgccaagcccttgttgccctggaggcttggctggctatagttttatgggtcgtggtgtatcctccgatacccttgtcgggtctcctcttgctgcatcaggcaatggccgtcacagcatgccaatacatgtaccgtctcgcagtaagtgccgtggcgtctaaataaaggccgattacagctaccctgaacagccaccatatcaagcctcatctacatcatcctccggcagaaattaggtgctggtcggtgcaccggtacgccggagggttttttttttttggtgggtattatcaattgctcggactatctcgttttcgattcttctcgtttcgcgcgtgtgattaaccagtcaaccctgaccgccaatattcctgctttggtgaacaggactcagactaagccattacgaaagatcctttcgcatacgaaggatacgatgacccgtatgtatggttatctacctacctacagcatgtacagatgtgttgcatcgtcaaggggatccgccctaccaatccatcaatgccacccagtttcgcagtgccgggtcaggtgagtcgttggttggtcagacatggcaacgcatggcgggcaccacggcatatcttgaccactttccagatgcatacacaggccttggccggcgattaggtattacgatgggcagtggtgagacgaatgtccggattaggtgtcatgttccagtgaacccgaggggtgggactccggcttcgcgaaccagccaatggcgcatctaggcacgggtgaggcacgggctcagcggaggtccacaaggcaaaagctagcactgctcggcactttcccaatcaccctccagccctgccccaggctctccttccatttccgaagcatgtcaccactctaggaaatgtaagcctctgaccacgagccaggcagccaggggtctccctccaagcggcacgcaccaaagggctgaatcatgcgaatgcgaacaaaggaagaggaagcgcgcgagagaagaagagggaaaccaaaaccacaccatatagccaccacccgacggttcatttgcccaaaaccccccgttgatggcttggcgggagggacccgtccggggggcagatcgccgggcttgcgctctccgtaaactgatcgacacagaagccgtcgctgcattttatacgctatgcagcgtctgtttcatgtctctgccaggatgcaggccctgaaggaaagggtaaggtagtatgacaccgctcctcagtacggtacacgatcttaccgtaatcctcacctaggctccgtaaagcgcccagtcagacaatgccgagcgcgcgcgcgtgaagaatccatcccctctgctcgcgcgcgagagcagtcggcggtcagagagaaggaataatcagaggagtcgggaggacgcgcgggtacttcggccgctacgaaaagaagaagaggagctattgcctcctcgcctctcccccaatggcatcgtgacccggattcttgggaattccccaccacctctacgcacactattgtgagtgcttaccttattatatccctttgcgagataacgaaacagagctgctacgccccaagtaggcaagtatgcagagaaggggaggggaaagaagcccggtaatcaaatccctcgtggcatcccagtacatgccttagtatggtggctaacacacagttgggaggtacctaccggggaaggcattgctgcataagacattatgtacaccacagcttcgttctatttggtcacttcgcgcgatccaagaaacactatatgggcaggggcaacacggaggttgccgaatttgtgtctgatgacgaagaggctacgggaggttaagatcagctattgactttctccagtgtattgtcgctgggtgcacgaaagcagggtgctaatttcctcttcagttcgttttcttcccaatagggtattgcctttcgacatgaacctctcgccacagagtatatttagctctagatacatcttgggatgctgctccttgcaggtcggcgaccactctattttcctcttccttccgcacggggcactctggcaggtacttcagggcgcctggtctgagcgggttttctagaatgccagccctcgactgggtgcgcacgtcccccgtgccatcatttgccatggaccccgtcctagcctagaaagtgccgatgcagcgacggccagggtgggcggtttgatgggtagcggctgatggggaaacggtggtcactggtaggttggtatgcgacctcattcctggcgggttaccctacacctgcagcctgggacatggcctgcagcgcttccctgctcctccatctcagaatagcaaagtgtgccatctgccgctgtcacgtccggggcggctcacgatgatgtcttgtctgatcttacccgcttacacaccgcatcgcattttgcctctctaattacagtggcaggtctatgagcagacctggtctcctcccccttggggtaagatgccctccatgccccgtggcttcggtaatataggtaggaggcactttcggctcagaatggcaacccaatgcgcgtatatgctgagttagcgctactgtgcgcaaatgacgagaggaggctcggcattcaactgcgacccagtgtgcgatccctggcagccctttcgcagcacaacgcagaccattccacacttggatctggctggcgagcagccgctaatttctggggtccgcgccggccatgacatcttactaccacaccgatccctactggcgcacccgtactatagcggaaaggaaatttgcgattaactacatagtacagagggtcggccgctgggcttcgagaaactcgctcgcattcgcgctggaggctgccctaggcatagtgctcgttggctgtcttggctgagcttggggaataaacaggcagctggttcttgagctaggcggcacttggcttgctattcccaagcctggcttgtccttgcatttccaagggttgccggacccagtcagatccagtgccttccttgccatgtggttcaagttgtacgaatagagtaagattgtacgcccaaaagccggtggcgcatggccaaaagccgcggcaccccctccacccctccggagcctaggatcgcgagagcgaggttcgctatgctatgtgggcaaaggaatcaagctcttacttcatgggtgggtttctttctcttcctcatctcgcaacgtgcaatctcattgcttggaatgcgacgaaggatagagagaatgcgaaccagagggaagattagagaggagagcccaagatgagaggcacagagcccaccccaggtccatcaaagagaggggcaaccgagcaaggcagcagcaaaacatgcagagagagagagggggtggttcaagagaagatgtgtcccgcaattgccagcttaccacgagaggccagattcgatagtttacggccgagagggcaggttgttgcatgatggaggctgtagcagttgcttgcttgcttttggcccccaaagcgacaataaacaagccctggcggcccttgtgctccaaaggaatttctcgctgccaatcctcctctggagttgcactgagagttctaataggcttagttacgggcgacaacactgcacaccacacacgtcagttattacgagaaggccaaaacaaagccttgggtttgatgatttgtgacggttcttgtgcggcaccgagggcttccttccttgtgcccatccccctccttccagccccgaatgggtgtcgacgaggctgtctggttggcttagctctcggcttgtcttgtgttggtagggcccgagttacgcaatacttacccattcttttctgcccaggactccagagaaaccagccacgacccttggcaaatgtgcgtgcgtcccatacatgatacatccacaagactgaagtccacccggaatggcaatgtaggtgggacgtcgaccatgggacttacggtagtcgaaattttaaagtctttcccagctacattgtacatgcgtctgcagcagcattcgagcaggcatcggggtttcccccttggcgccgactgggaaagtcccaaagtgcctatttctgcgtttgcctgcggtgtctatatatgggacccccccatgacaggtgccgatcgaaaaaggctgattcctgaatagggcgtggccgaattcctggtttgcgcacggcgaccgctggctgcagttaatataaagatacataagaggcaatatcggagcagtcccatttgcgaaattttttaatttatctcgtgttttgggtaagtagagccttgtttccaaatcagtgcgtcttggcccgttggtgcttgttttgactagatgattacgcaccaccgcctgttggtcccaagtggataactaatgtatgtgtgtgtgttcgtttgcgacattacaaaacataacatcagcggacatgtcggattatggtgggatgtgggatgtggggacgggggcagctgaagacgtacagtcgcagtgccagcaagcacgcctgataacacgaagagcctgatttttttgttgggccttgggcgaccttttgttactctcgagttgggcccgtttggtttgattgcgaccgtcgcttggtggtggtggtggtgctgctgcttgctgcacgggatagagaccaccttggccagcctttgcttcaggttgggcggccctgcaacaacgtctcttgcatccgtcagtcgttactctgctggcactcccttcctcacacacgcaaacggagaacctagcccagccgacggtagcagtcagccctgtgctggacctgccggccgttgggtggcttcgtgagtgtgtgtgtgtgtgtgtgtgtgtgtgtgtgtgtgtgtgtgtgtgtgtgtgtgtgctggttggctgtgtggaacacccagctggcgtttcgcgcatgcaagatgcatgtacgatgatggaggaatccgtcatgctacgaagctaaactttcgctacgaccctgacgataggcgtggcgcccaaatcttatgtcggagatgtacttacgttggagagagcccactgctgaatcgaggaaatcagataggcccaacaggtaggttcgttggaaagtagcgccgaagaggttggttgagatcgcttggatcagcccattccccttcgacgtcccaacccacctgacatccctcatcccgggggctctgttggtttaattcggtccccaggttgcacctctgggcggttgcgtacatgttttaccaacaaggcaatagatcaattcaatcgacacatcacaccctccactgctttctgaatctcacgtacatggtagagaatggccgcatggtatgtaggtgtgcgccacggcactcgcttgcatttacatccctgtagctgtggtgccggatgtagttccaagagggcccggctgcgtgtccccacggccgcaatgccctctttggcgagaccttcaaggtagccctctttcttcggattcgctcgacgcactgcaaaaaagtgcgaagtgagcaaagacgagaaaggaagcttcagcgtctcgcccttttcccacacccttttcccacctgtaggagaccctcccccttggaaccaacaaaccacccaaccaacacacccctggcatcgaagcccaacaacacaaaaggcctaaccaacccaccgtctagcgctcttgaacatacgaacccacggcccgaattctccccactcggctacctgatcagatgggacgtagctgccaacgtcggccagaattgtgcgctcaggatgtggcatcagcgcgaggactcggccgtcgcgacttcgcacgccagcgatgccgcctgggcttccgttcgggttgtacgggtactgatccggccctgccacctccagtcggttgtttacgtacttgatggggatgaggccgtctgagttgagcacgttcaggctcgcgtcgttggtgaaggaagcgcggccttcaccgtgggcaacggcaatggggagggccgacccgctcatgccgtggaggaagactgagggtgtctccgaggctgagtcgtcaatcttgaccatggtgaatcgagcctcgtattgccggcttgcgttctccacgaatgtaggccagttctccgcccctgggatcagctccttgagacgcgtaagcatctggcatccgttgcagacacccagggcaaaggtatcagggcggttgaagaaggtttggaactcttgacggacgttcttgtgctccaggatagattgtgcccaacccacaccggcgccaaatacgtcaccgtaggagaagccgcctccggcagccagaccgacaaagtctgccagggagcgtccttcttggatgtcgctcatgtgtacatcaataggctcgaatccagctgccttgaaggcaaatgccatctcacgatgactgttgacaccaacttcacggagaatagcaactcgaggagcgcccttaaccaagcccgtcaaggaagctgtaagaggtaggatattctcctctggagagtacttgagtctgaaggacaggccggggtcgttagaatcggcgatagtattgtactcagcctctgcactggcaggattgtctctctccctttgcatggcgtaacttgtttgtgaccaccactgctggatctgagtacgatccagggtaaccacgggtcgggcaccatacttgatgttcaatgtctgcttcgatttcggctgtacagcgccgaatttcttgatgagtccagcgggaggtccacatgtagcgaagcatctcttaaagttaatctcgtcgccctttttgatctggaagacagcgccaagctcctcattgaagagggcgtccagaatgtccccaatagagccagtattggagagttcatcaagttcgatatcaactccacaacggccagcgaacatcatttcagccacggttgtgatcaaaccaccgtctgagcgatcgtgacaggcaagaacaactccggctttgtgaagttgggagagggcatcaaagtaatctgcaatgagctcagggcttcgtacatcaggggcctcgttgccaaccttgccgaaagcctgggcgagtgcagagccacccatggctcggtgaccctgagcaagatcaacaaacatgagcacagtttctccgacatcctcgtatcgtcgaagctggggagtccatgtgttgcgcacatcttcaacaactgtgacagcagtgatgatgacggacatcggggcagttacgctcttggtttccttggtctcacggtctttccacgaagccttcatggatgtagaatccttgcctacggggatggagatgttaagttgagggcagagctccatacccagagcctggacagcctggaatagtccagcaccctctccggggtggttaacggccgccatccaattggcagagagcttgattctttccatgcctcccaggaagtctgcagcgccaaggttgagcagactctctgctacagccatgcgagcggatgcggcaggggagatgagagcaataggagggcgctcacccatagccattacttctccagttcgctggttactgccgatgctgaacgaggttgcggtcacagcgcagtcagcaacgggtgtttgccaggggccgaccatctggtcacggacagagagtccaccgacggttctgtcaccaatggtgatgaggaaagacttggatccaacagagggcatgtggaacacccggttcacagcttccgagatgatcacatctttggtagcgtcggtgccacagaccccctggagggccgaggctgcgttgaaagctggcaagccaaggtctctggtctcgaccacacgctcaagcttgcgtccagcagggaacaatgcatccattggaaggtcaatgggggaaggtccgtcctttgaatcgcgatctgtgaggacaagcttggagtctccttctggggtcttgatggcgacggttccaacatcggagaaggggcatcgctctcggcctgggtatgtttagtacgagagtattatgggatagcggaaattggatcaacttacggcagatgcttgtgaatcgattgacaccatcccggttaaccaaaagaacatatcgttcctgggactcgttacaccaaatttgaagagggctcatgctactatcagcggtgtgaacttgacgcagctcaaagtttcctccgaaaccggcatccttgacgatttcgggaagtgcgttagacagaccacccgcaccaacatcgtgaatcatagcgatggggttttgctcgccaagagcaacacaagcatcgataaccatctgagctcgtcgttgcatctcgggatttcctcgctgaacacttgcaaagtcaagctctgcagtctcttcagcagaggcgttgctagaagcggcaccacctccaagcccaatcaacattccaggtcctccaagaacaatagcatgggcaccatcttgaacatcctcaggattcttcagggcgtgctggggtcggacagttccaacaccaccagcaatcatgatgggcttgtggtatcccctccactcaggagagccttccttgcccacatcagtcaagagcgtacggaaacatcctaggagacaaggacggccaaactcattattgaagcgagcacttccaataggtgcttcaagcatgatgtcaagactgctagcgaagtgtgaagggcggcccaagtcgacttcccaaggcgctttctgatccggaatgaggagttcggagacccagaagccacaaagaccggctttgggggtggagccacgaccaacggcaccttcgtcgcggatttctcctccggagcctgtggcggcaccggggaagggcgagatagcagtggggtggttgtgagtctctactttgatgaggacgtgaacaacctccttggttagtttccaagtacccgtagaatagtcgggggcccagaaacttgcggtctctccctggaggaccgcagcattgtcactgtaagcagacacagtgaaatcaggggtgtgcttgtgagtgttgcggatcatcccaaagaggctgtgccccatgtcaacaccatcgatcttccagttagcattgaactgcttgtgtcgacaatgctcagagttgacttgggcaaacatgaagagctcaacgtcgtgaggaggtcggccctggcgtttgaagacctcaaccaagtattccatctctgactcatcgagggccagaccaaattgcttgttgtagtcacgcaggatctcaatgggagaagacccaggggcaaaaatgtcaacaatctcaagagggtatctctggccctcctggaacatgagattgagatctgggtgggatgtagagagggattctgtcatccggtcgtagatgatatcctttgactggaacttgtcgccctcaaaaggcttctcaaaggtaaccgtaatggccctgcctctctcaatgcgttcaatgtggtccttcaagccgcacacatgagagatggaggtacccttggagctccatggggagatattgcggggtgagatataaaaagtggtggtggtgtcattgctcggggcgattgagctcgtctgctggtctggaaggtcgagccacttgcccagcttctcagttacgagagcagactggtcgctcttgaggtgcacatagtaaacccagacaccgtgcaagtgggcaacgggaacgtctgggctctgcttgttgatgcgcgagcgcagctcctctgcctgggtagaagtgaaggcagagcctccaaccaacataagagactgcatgacggcttatggatgatggaagcaatgatcaaggtaagtcatttgccaggcccgagatcggtgagaatttctcctcatgaccaagaagaggttgtaagtttcttgctatcgtcgtggtggggtgaagacgataaattttggaggggcagaccaaagcggcatagtgtgatctcatgcgtcgcttcctgcaggtactttgcgaagtacctctgtactagcttaggtaatcacgagcacgggccagtgatgctaatgataggactcgggatggatggaaatggatgggcgggagacatccattacgttgcatcgccaattgcctgtgcccgcccagttatttatacatactactgtttctcaacccctgtccatccgtaatatacttctcgcgtctcccgcttcttccataagccaggcttcacttcttcgctcccaaccatcctgtcctcccggcctcttcttgccgactaatgaccccgttgcattgatatcgaccacctccactgcgactccttgacccattccccgagccgtcttctttccagcagcgcgcgcgcagccaatttgctgatatccggagtcccgagcgctcctccacctcatcatgtcttggctcacatccttaacgggcgtgttagcgcccgtgttcctggtgctgtcgccaatcctgtcctacggtgaccaagcgtactcgatgcatcgcaagcggaccagcgcgggcttttccctcgacattccactgatcatgctggtcgcctcctttctcaggtccggaattcatcgcttcatatctacacttgaagagcgcagctgactggttcaaataggatttgctattggcctggtgcccgcttcgatacgagcctcttgttgcaatcgatacttatggtcgctgttcaagccactctgctgaagatcgcgctcgaccataggccaccaccttcatccaagggaggagaggcagctttgccattcgcaggagccggcaaagacagcatcctcgactttgagcgcccattcaacttttggaaatggcgttccccgaagccgttcgtttgacccccgataaagcacattacggactcttactaacaaggcattggccgtagatattggaagtttttggtttggtttgcagctggacttctcgcctgcgaaatgcttctgaaaccagcgcctcagctttataatctatactcttccacgatcggtgttgtgggtctctcaatcgaagcgacgctgccgattcctcaaattctggcgaacgcgcagtcaagatcctgcaaggggttccgcgtctcagtcttggctagctggattctgggtgacacgatgaagctgttttggttcttcaccacaactaccgagattcccccggtgttcaaaatctgtggcatgttccaggccgcatgtgatgctttcctcggcgtccaatatctgatgtacggtgaaggcgaacaagaagttaaggagcatccgatggcggatgcatcgtggaagagtccgagcatggatcgctcttacattcaaagccaacatagctcgtctcgaagttcaacccccacaaggccaaggcgatcgactgtgacgatcgtggatgttaaagagaaggaattacaataaagaaccatgggcaaagatgtatagacttggagttattagtttgctttatagattagtgtgaactaggactatttttaataggatatataggacaggtgctcttttcgagttggatgcactgaatttaagaaactgaccttggtcccatactgggaataccgtcagatcaattgcgagaaagcttgtgacaataggtaggttaactacttaatttcgatagaataattgaaaaactaaagcataataaacatcaagttgcaattcagcataccataggtgaggtaacttggaatataattgctgcattgtagggtagctctggtcccaggtgtagcccagcagctgcgaactcaattcaaatacccgctaccacaacagagaggaatggaaagcttccatatctgcacaccaggctgataggcgttcgatactacctctggagtgattcaattaagctgagccaacaagtgatgtcactgacaaccatgcggttttggactcgacccctgattcccaatttattgagcgttaaggagtgataggagagtacttctgttcagactttaattacttctgcgatctggaggctctgcatttactgcaaaattaaaatatctatgatcttaagcaatttgtttttctatccaggaatattttttagatgccaggaccacgtcgaagctaaatgggggcttgagttgtggcatcctaaaagtcgcactttatctggctgtcaccaaattacccgttttggtctcccagccacccgacttcttgccacaggaggctacctcgcaacagccttgattgattaccatttgcaggtggccgctgtactttcacgtacatgagaggcatcagcttatatacattgatcaactgaagcaagcgatcttttttattcgaattgcaaccaataccccaactgtttgtttacaggcgtgtcgcccttccgtcttgctgtcgatttatttggttcccaatcaacgacgcctcctggatcactttgttgttatcaccagagatatcaagaactctttggacatactcaggtcgtgcactaacaaacaaaccatcccttaccgtcttgaaacggttggcctttgccatataccgtcttggtgcgcaactgtacgccatatatacacatgctaggagtaggtagaagcacaatttctcactttcctgccagaacttcctcgagaatcgtgcaaggtgatggatcgctgagatttcctcccatcttgagccctgaagttgcttgttggcgcccaggcacttccatctacatttcttcattataaacacaaggtctgaccatctctttagccgatagctcgataagtccagctcaccccaagaaataactctctattccgtaagtgcacgcatttctctgtagcgggattgattcttttcgacgagctcggccaagtgtttgacgcagcgctggggcaatctgagaatcagctgcgagcgggctgagtattgtgtcaactggatgcgcttgccagcgaccgacagcggctgcttctggttctcactttctgcccgcacgtgctgcaccttccctctgttttggctggccctatatatcctgccccttctcacttcctccctcttcctccctcttccatcccgacatgccttcagcgtaaacaacacgttgaagctagcatccacccaacgcagctcccttccagatctcctaataaccagcgatagctgcacctagagagagcattttgccctctcctccctcccagctcaaagaactgccagaattcttgagtgtgagtgttttgaacacctcctttgcctgcacaatggccgatgccttcttgacgcttgttgaagcaatcctcaacaaccaaatgcatctacatcggtagaaactatatactaacaaaaaatgaaatttccagccgaccattcaccatggcaccgcaagccaaagcaaactacaagtcttacgaggctcaggctcgccttatccgggctattgttgctgcccatcctgaagtcaaatggaactacaaaggtaagcttacagatactgcactttacttatgattttttatcctttggccacacgcgttacctcaaacgcgtttcttggtcgccatttcatcacaacagttcttgcactctggacacccaaggttgacatatctggtcttcctagagattgtcgcctccttcgggagcgatataactgaggatgctctcaattatcgattccgacgactgcgtgctgaggcggttatcattcgctacggaagggatacaggattcgacatgaaacatctcagcgtcgaggacttgcccaagacgcaagccactgttgagaaaaatagtacgcaacaactaaatactaccgaggatggctatagggttttcattgatgatgttgagttggcgctaacttttgactcttagatatctctcaacaccttggccagtcaacccctgatggcattcagtttcaattcagaaccatcaagaaggatgcagaccaccttcgcaaggtcaaggctgccggaggagatgttgccaactgccttccttctgccggttccggcggaagcgtcaccagcactcctaccaaacgtacaccctccaaggcaactccctcgaagggttctcgtccccgagcctccgctaaacggggccagggatatatcaaggaagaggactcggctactgaggaggagtctgaagacttctccgaattggaccaggagaccccaagcaagcgacagaaaactgtcggcaggaagtctgctactccatcgcgacatttcctgcgtgcggcgagggctccatgggttatcccaatcttagagcgatgaattgcaaccggaaatgaggtaatacaagaagccatcgacgatacatcgacacgtgccgaaaatagatgccctgtaaatgagggagcaggtatttcggaagaagtaggcttctcttctgtgtgatttaaaaaaatattccttaagacccagatattatcctagggtagtttaattttgatgcgtatatgagaatgatgttgaaaaactaaagtttaattattttttggatgtagacgtgactcgagagacacagggaccacatatgcatatgtatatatatgtgtatgttcttttggcatgtgttcaagatagaatattagtcttattgacggtctgtagttgttagtttttggcagctaatagttgaactacatgacgcgtatcaaaagcgtcaaggacctttctactagaagttacagaatggcagacatgcgagtggcacaaaaatccctcaacctacatcatcactaaaagatcaattgctctaaaagaatacagaatgtctaggttagacaatgaggcgaagattattcttgcacttaaatcattcaagcgaacccaaaagtaggcgtgcgacacgttgcgcagatgtacagcgtgccatagaacactatatcgtcgacaaccaggcacgcctggcagatgcgatactatagcgtattcacggaaattatctagtcttgaagaacagaagctggctgactatattcttgacctagatatgcaaggagtttctccctagctatatagtgttgaagaaagggccaacctcttgcgtagtgatcgcgatacatcatccgttggatcaggctggatttcgaattttattaagcggcaaccacagctccgaacgcattattttcggagatatgactaccagggagctaaatgtgaagatccaggcgcaataaacgcgtggttctcccttgtggcaaatacaatcgcgaagtatggcatccgcctagatgataatcataactttgacaagactggcttcatgatgggcgttattgcgagtggtatggttgtcacagcacagaacggcgtagggaccctaaaaaagtgcagcctggaaaacgtgaataggttacggtcattcaatcaatctccacaggcggctgggcgacgccgccatatatgattgttgcaggccaatatcacctcgccaaatggtatcaagaaagaggcctcccacacgactgggctattgtaacaactaaaaatggatggacagacaatgagacaggccttagtgggctaaaacactttaaccaacacgcaaacaaaagatcaagtggtgcctatcgcctcctgctcctggatggccatgaaagccaccactccgctgactttgaagcatattgcaaatagaacaagatcatcacactctgtatgcattgtccttcttttcatccactctagcccttagatgtgggctgttttgggccacccaagaaggcatatggtcgagaaattgagcaattgatgaagtgctcaattacacatattaccaaggctgacttccttcctacattccacgacgcatttcaagctacaattaataaaggcaatattgatggagaatttacaggggccggtcttttccttctgaatacagaccatgtgagatcaaagctggatgtgtagatacacactccaacacctccagaggggagctcagagcttcctgacccttgggtctcaaagactcccaaaacaatcaaggagacaaaatatcagcctgaacatattgaaaaacgaatcggaagatataaaagcagctctccagcatcaataatcgaagctatgaagtcaatgacaagggattgaaggaacatcagcatgagatggcgttgatgagggcagaggtccgggagcttcaggaggctaataacatcctcggccgacaccgcagagagaaaaagacccgcttacgaaatggaagaactataacagtatgggagggttaggcattaattgatcaaatggatgtggataagcaggcagtggctgaatcgtcgaggagaggtggtcaggcaaggtcgacatagccaaggggaaggcattgcggtgtatgcgggaagactagggataatgcaaggacatatacagttgatatagaggaatctgggaaagagtttagtgattagttttaattgatataataggttgttgtgttttaattaaagttcttgttataaagggcgggaaacgtgacgcattcgctgtgctgaggcactcgctataaatgtacgttagcatctattattatatttagtttactttacacaggttatctcaaataagcacttagaaatgatatcttctatgtaaacacttttacagctaaagcactattacttactagctacaatttcacccgcgagtgctctaagggctcattttttgtatgtgcgttcacgatgaatattgagggtgcaggaaaactggccatgtctgtctgatattcaatacatcagaagacaagaaccttgtcttccagtaagataggactggaaggtgccgtttaagagctggtgaaaactattcgtattgatttgataaaacatgcacttctaaggaaacatctttcggtatagagaggggagttaggtcattcagaccttaacttctacatgctttaggaaatgatacatatgatgcataccctccagcctcgagtgataccagatatatggcaaaataagtaaatgcttattcaactatgagccaggcctttcgaaataccctcgataatggccaatacacttatagctcctgggtctggcacctgttcccagccctgttcattcacgtatactgcccttccaaatgccggctgtaggcccttagttgagtcagatcccttccttgctgcctgcaatccctgctcaataccgtcttgcaatgagtaaacgaatggctcaagcgcatccatcagagttcggtcgccagatcgagcgggtgtaaccttttggacagtcttcaatcccccaagagcaaccatggcccattcttgcagtcccattgtcacagtgctatccagctctctcagcttagcagcaaggccgctgaaaaataaagcatagatagctccagaagtgccatccatattttcttccacttcataggcgatcttgatcatcaagtccaagacgttatctccagaggtggaggcgtcgtctattagttttaatactgctttgctgccacgctcaagggtcagaccacaatcaccgtcaccaacaattgtgtcagccttggtaatggatggctcggcggcaatcgctgactggcaggcgctgctgatcacggaccgcagcagctttccattggcttgaaaagaacggctatcagtaagcatttcgaaaaagccttaagccttgttaaaaggaggagatggcttacttttcgcacttgacgaacttatgactcttttctcaccctgtatggcggttgactgagtatcgattactcttccagttgcatttctttcatcgggggaaatgtaaggaacgggccaaccaggcactgacgtaggagcatccagatattgcaaaagctcccaatctgccttgagaagtgtgatgctaaagcctggtccatccaagcttgtcatgaaggttccgctgtatgttctaataggctttatccctcgaatgcctgtgaatagttagcttaggttgcctttaaatattgtgagtctttccccattaatacctaaacgtcgaatagtgtttgttgtaatagtatttgactcaaggatggacagcgacccaagattgttcaccatcagaactatatcatcagatgctgcgatatccacataatttcgctctgaatcattagtatccaggagatagctgagcatcttgtcaagcaaatcaggaagttctggctttggcttgagcaattcagctccaggctcattatggatgcccatgcctaattcaagctcatcggcagcaaggtggatttgagaatccgtctcttgaccaggaatatccacatggtccagcgaagcgccgactgtggccagaccggcgttaaccatgtctgatagttcaacacatgcctcaagtgacctgccagctgctgaagcagcgcctaggatcttatgcatcagcacagtcccggccaagcctcgccttcctacctttccagccttgctcctctgaagagaaacatcatcgccaacaacaaccacatcaaccttgatccctagctcagcccggagcttctgggctgcctggtggaagtggaagatgtccccggtgtagttcttaacaatgaggatagtcccagcagcaccattggcgttgcggatgcagttgtagatttggcttacactcggcgatgcaaagatgttgcctgagacggcggcgcttagcacgcccggcccgacatacatggcgtgagcgggttcgtgagcggcgccgccaccagagacgagggcgacatacttcgaggggtcgtgaagtgttgagtagacgactacgaaccaattgtcaataattactgagtcttcgcactttttttttgcttcggattacagtggacggggtttgggatggggagagtgggctcatactcttatgctgcttatcgagctggatgcccgggcgtagatgggtgaggctctcgagggagtctgccacaaggtcggcagggttgccattgataaagtgttttgctgacatttctttgggcgtatcttgcgatggtttctccctctcacttctaagctattgtgaagcgggtcacatctggggtatttcacgtatatacctccatgtcttgaagctgtccacaaatctccgaagacctggcgggctatgtgcttttccatcacgtcttggatccattctttagcgggcagattgcaatgtacagggttcgttggcagtcctgcgggttggtccaccggcatcggaaaagggggttatcggaattgtggccaccggaattccaccttttagcacaatcggaattggtatcttcgctcttttttgcggaattgatcaacataatttaggtcggcatttgctccacccgagttatcgtctgtgacttcattatccgcgggtctgtcaaaatggacatctgacagggccgcatgattgaaaaaggccagggtgaggatcgttttgctacccaaagttcccacaaataaacagcatctgcatttttttgatacacaaatctttggaatggcttcctatcccgaaaacaatcgaacgtggcagattatccacaatgcccgcaagggtggatatgcagttggcgggttctgtgtgtgagtctcatctctcgtcttagacaaccccctttcggtttgccatccatggtgtaagtcttggaaagagatgatgcaagctgatgttgcagaatggcagatacaatgctgaaggtgtcctggcagtcattaaggcggcggagagatgtcgctccccagccatgatccaattcttcccctggaccttgcacttccatggccctgcctttatcaagtacgcggtcgacgttgcacacgccgcttcggtccctgtgtctgtccacctcgaccactgcttgaagccgagcgatgcggatctggcactagagtgtgcattcgactccatcatggtggatgggtcgatgtacgacgaggagggaaatgtcaaatacgtcaaatcggtggtggacagagccaggggcaaggggatcacagttgaggctgagctggggaggatggagggaggagaggacgggctaccgacgattgacctcgagagcgtcttcaccgatcccgacatggctgctgactttgtcaagaagacgggcgtccacttcctggccccaagctttggcaatgtccacggaccttatcctgccggcggtgcagagaagcactggaggctggacagattggagaagattcacgcagctctgggcgatgcgacgccgctggtccttcatggtactcacccgctctcagacaagatggtccaggtgggaatggcacgagggatagtcaaggtcaatcagaaccggaatgtcagaaacggatatcacaagtacattgcagagaactgcaacaagcatttcctgcgtgcggcgagggctccatgggttatcccaatcttagagcgatgaattgcaaccggaaatgaggtaatacaagaagccatcgacgatacatcgacacgtgccgaaaatagatgccctgtaaatgagggagcaggtatttcggaagaagtaggcttctcttctgtgtgatttaaaaaaatattccttaagacccagatattatcctagggtagtttaattttgatgcgtatatgagaatgatgttgaaaaactaaagtttaattattttttggatgtagacgtgactcgagagacacagggaccacatatgcatatgtatatatatgtgtatgttcttttggcatgtgttcaagatagaatattagtcttattgacggtctgtagttgttagtttttggcagctaatagttgaactacatgacgcgtatcaaaagcgtcaaggacctttctactagaagttacagaatggcagacatgcgagtggcacaaaaatccctcaacctacatcatcactaaaagatcaattgctctaaaagaatacagaatgtctaggttagacaatgaggcgaagattattcttgcacttaaatcattcaagcgaacccaaaagtaggcgtgcgacacgttgcgcagatgtacagcgtgccatagaacactatatcgtcgacaaccaggcacgcctggcagatgcgatactatagcgtattcacggaaattatctagtcttgaagaacagaagctggctgactatattcttgacctagatatgcaaggagtttctccctagctatatagtgttgaagaaagggccaacctcttgcgtagtgatcgcgatacatcatccgttggatcaggctggatttcgaattttattaagcggcaaccacagctccgaacgcattattttcggagatatgactaccagggagctaaatgtgaagatccaggcgcaataaacgcgtggttctcccttgtggcaaatacaatcgcgaagtatggcatccgcctagatgataatcataactttgacaagactggcttcatgatgggcgttattgcgagtggtatggttgtcacagcacagaacggcgtagggaccctaaaaaagtgcagcctggaaaacgtgaataggttacggtcattcaatcaatctccacaggcggctgggcgacgccgccatatatgattgttgcaggccaatatcacctcgccaaatggtatcaagaaagaggcctcccacacgactgggctattgtaacaactaaaaatggatggacagacaatgagacaggccttagtgggctaaaacactttaaccaacacgcaaacaaaagatcaagtggtgcctatcgcctcctgctcctggatggccatgaaagccaccactccgctgactttgaagcatattgcaaatagaacaagatcatcacactctgtatgcattgtccttcttttcatccactctagcccttagatgtgggctgttttgggccacccaagaaggcatatggtcgagaaattgagcaattgatgaagtgctcaattacacatattaccaaggctgacttccttcctacattccacgacgcatttcaagctacaattaataaaggcaatattgatggagaatttacaggggccggtcttttccttctgaatacagaccatgtgagatcaaagctggatgtgtagatacacactccaacacctccagaggggagctcagagcttcctgacccttgggtctcaaagactcccaaaacaatcaaggagacaaaatatcagcctgaacatattgaaaaacgaatcggaagatataaaagcagctctccagcatcaataatcgaagctatgaagtcaatgacaagggattgaaggaacatcagcatgagatggcgttgatgagggcagaggtccgggagcttcaggaggctaataacatcctcggccgacaccgcagagagaaaaagacccgcttacgaaatggaagaactataacagtatgggagggttaggcattaattgatcaaatggatgtggataagcaggcagtggctgaatcgtcgaggagaggtggtcaggcaaggtcgacatagccaaggggaaggcattgcggtgtatgcgggaagactagggataatgcaaggacatatacagttgatatagaggaatctgggaaagagtttagtgattagttttaattgatataataggttgttgtgttttaattaaagttcttgttataaagggcgggaaacgtgacgcattcgctgtgctgaggcactcgctataaatgtacgttagcatctattattatatttagtttactttacacaggttatctcaaataagcacttagaaatgatatcttctatgtaaacacttttacagctaaagcactattacttactagctacaatttcacccgcgagtgctctaagggctcattttttgtatgtgcgttcacgatgaatattgagggtgcaggaaaactggccatgtctgtctgatattcaatacatcagaagacaagaaccttgtcttccagtaagataggactggaaggtgccgtttaagagctggtgaaaactattcgtattgatttgataaaacatgcacttctaaggaaacatctttcggtatagagaggggagttaggtcattcagaccttaacttctacatgctttaggaaatgatacatatgatgcataccctccagcctcgagtgataccagatatatggcaaaataagtaaatgcttattcaactatgagccaggcctttcgaaataccctcgataatggccaatacacttatagctcctgggtctggcacctgttcccagccctgttcattcacgtatactgcccttccaaatgccggctgtaggcccttagttgagtcagatcccttccttgctgcctgcaatccctgctcaataccgtcttgcaatgagtaaacgaatggctcaagcgcatccatcagagttcggtcgccagatcgagcgggtgtaaccttttggacagtcttcaatcccccaagagcaaccatggcccattcttgcagtcccattgtcacagtgctatccagctctctcagcttagcagcaaggccgctgaaaaataaagcatagatagctccagaagtgccatccatattttcttccacttcataggcgatcttgatcatcaagtccaagacgttatctccagaggtggaggcgtcgtctattagttttaatactgctttgctgccacgctcaagggtcagaccacaatcaccgtcaccaacaattgtgtcagccttggtaatggatggctcggcggcaatcgctgactggcaggcactgctgatcacagaccgcagcagctttccattgacttgaaaagaacggctattagtaagcatttcggaaaagccttaagccttgttaaaaggagggagatggcttacctttcgcacttgacgaacttatgactcctttttcaccccctctggcggttgactgagtatcgattactcttccagttgcatttctttcatcgggggaaatataaggaacaggccagccaggcactgacgtaggagcatccagatattgcaaaagctcccaatctaccttgagaagtgtgatgctaaagcccggtccatccaagcttgtcatgaaggttccgctgtatgttctaataggctttatccctcgaatgcctgtggatagttagcctaagttgcctttaaatagtgtgaatctttcctcattaatacctaaacgtcgaatagtgttggttgtaatagtatttagctcaatgatggacagcgacccaagattgttcaccatcagagctatatcatcagatgctgcgatatccacataacttcgctcagaatcgttagtatccaggagatagctaagcatcttgtcaagcagatcatgaagtgctggctttggcttgagcaattcagctccaggctcattatggatgcccatgcctaattcaagctcatcggcagcaaggtggatttgagaatccgtctcttgaccaggaatatccacatggtccagcgaagcgccgactgtggccagaccggcgttaaccatgtctgatagttcaacacatgcctcaagtgacctgccagctgctgaagcagcgcctaggatcttatgcatcagcacagtcccggccaagcctcgccttcctacctttccagccttgctcctctgaagagaaacatcatcgccaacaacaaccacatcaaccttgatccctagctcagcccggagcttctgggctgcctggtggaagtggaagatgtccccggtgtagttcttaacaatgaggatagtcccagcagcaccattggcgttgcggatgcagttgtagatttggcttacactcggcgatgcaaagatgttgcctgagacggcggcgcttagcacgcccggcccgacatacatggcgtgagcgggttcgtgagcggcgccgccaccagagacgagggcgacatacttcgaggggtcgtgaagtgttgagtagacgactacgaaccaattgtcaataattactgagtcttcgcactttttttttgcttcggattacagtggacggggtttgggatggggagagtgggctcatactcttatgctgcttatcgagctggatgcccgggcgtagatgggtgaggctctcgagggagtctgccacaaggtcggcagggttgccattgataaagtgttttgctgacatttctttgggcgtatcttgcgatggtttctccctctcacttctaagctattgtgaagcgggtcacatctggggtatttcacgtatatacctccatgtcttgaagctgtccacaaatctccgaagacctggcgggctatgtgcttttccatcacgtcttggatccattctttagcgggcagattgcaatgtacagggttcgttggcagtcctgcgggttggtccaccggcatcggaaaagggggttatcggaattgtggccaccggaattccaccttttagcacaatcggaattggtatcttcgctcttttttgcggaattgatcaacataatttaggtcggcatttgctccacccgagttatcgtctgtgacttcattatccgcgggtctgtcaaaatggacatctgacagggccgcatgattgaaaaaggccagggtgaggatcgttttgctacccaaagttcccacaaataaacagcatctgcatttttttgatacacaaatctttggaatggcttcctatcccgaaaacaatcgaacgtggcagattatccacaatgcccgcaagggtggatatgcagttggcgggttctgtgtgtgagtctcatctctcgtcttagacaaccccctttcggtttgccatccatggtgtaagtcttggaaagagatgatgcaagctgatgttgcagaatggcagatacaatgctgaaggtgtcctggcagtcattaaggcggcggagagatgtcgctccccagccatgatccaattcttcccctggaccttgcacttccatggccctgcctttatcaagtacgcggtcgacgttgcacacgccgcttcggtccctgtgtctgtccacctcgaccactgcttgaagccgagcgatgcggatctggcactagagtgtgcattcgactccatcatggtggatgggtcgatgtacgacgaggagggaaatgtcaaatacgtcaaatcggtggtggacagagccaggggcaaggggatcacagttgaggctgagctggggaggatggagggaggagaggacgggctaccgacgattgacctcgagagcgtcttcaccgatcccgacatggctgctgactttgtcaagaagacgggcgtccacttcctggccccaagctttggcaatgtccacggaccttatcctgccggcggtgcagagaagcactggaggctggacagattggagaagattcacgcagctctgggcgatgcgacgccgctggtccttcatggtactcacccgctctcagacaagatggtccaggtgggaatggcacgagggatagtcaaggtcaatcagaaccggaatgtcagaaacggatatcacaagtacattgcagagaactgcaacaagttgttttcccaaactgctacatcatctttgccaatcttatttcttcttcttgtcctttccgaccagtgcgtcgtatgcaattccaagtcctagactgcccaaaatcttgttcagcccgaggcctcccaagataccgtcaactagtgtaccaagaccgagaccgctcagctgcgatgcgtgttagcagggtcgttgacaagcaccgagtacctagatagtcagttggctttggacaacttaccagtctgccaaccagtccgagcacaccggtcagaagcaagccgacgcctgcgagaatctggcccagaggctccatcaagagtccccacaaggggttcagctccttcttagcatgaggcatgccctcaatcttgcgcttcgcgttgtcaattgtttgggttatggtaccggtgagctggttccgtgggtgttagttcgtccgtgtttcgcatcagtgatgccatccgtaggttcaaacatacctccttcagttgctctgctaagtgatgctcctctgggcttgcctccctggtacctgacctttgcttggcytgtctttgaatacggccgccagggtcgaggccgcggatgataccactggtctcactgaggatcttgccgccttcttcaatcaggggcttcacttctctaaccagcgcttcctcgtcaagctcttctttgggtgtgcgctctgcgctatcaatcttgtctgtgatcaacttgcaaatgggccggatcttatcaagcgactgctcaatgcacgcgccgttgttttcccaaactgctacatcatctttgccaatcttatttcttcttcttgtcctttccgaccagtgcgtcgtatgcaattccaagtcctagactgcccaaaatcttgttcagcccgaggcctcccaagataccgtcaactagtgtaccaagaccgagaccgctcagctgcgatgcgtgttagcagggtcgttgacaagcaccgagtacctagatagtcagttggctttggacaacttaccagtctgccaaccagtccgagcacaccggtcagaagcaagccgacgcctgcgagaatctggcccagaggctccatcaagagtccccacaaggggttcagctccttcttagcatgaggcatgccctcaatcttgcgcttcgcgttgtcaattgtttgggttatggtaccggtgagctggttccgtgggtgttagttcgtccgtgtttcgcatcagtgatgccatccgtaggttcaaacatacctccttcagttgctctgctaagtgatgctcctctgggcttgcctccctggtacctgacctttgcttggcctgtctttgaatacggccgccagggtcgaggccgcggatgataccactggtctcactgaggatcttgccgtcttcttcaaccaggggcttcacttctctaaccagcgcttcctcgtcaagctcttctttgggtgtgcgctctgcgctgtcaatcttgtctgtgatcaacttgcaaatgggccggatcttatcaagcgactgctcaatgcacgcgccgagctgtccggcaagcttcctgtcctgctctgcctcggccttttccttggcttcttcctctcgagccttcctctcctcctcagtctctacctctagagaaatatcttcgattctctagagacacatggccaatggcgttgcccttcgagttaagcacatcaccatcgtcgtcgatctccttgccagagcagattagaagatcaccactaatgagtttgccaatgatgttgccatcatcatcgacaatattaccttcacggtttactcgtcgaccggcaagagggtccttctttatctctatttcaggctcttcccatcgctcagcctttcctaggatattgccattcctgtctataatatctccgtcctcgtcaactgagcgtccatagaggaccttggggtctccggatataagtctaccgataacatcaccggatggggtcacaaccttgccatccttggttacggtaaggcctgatagctctgcaaatggaccctccttggatccttcacgctcgctctcagaaacgatttctgccttgccaataatgtcgcctgattcgctgcgaatattaccttccttatcgcacatacggccaacaatggcaagcagatttccctcaatgactcggccatagatggttccagcagagtcgacaatgttgccccttttgttgacacgcttgccaaccaggacagaccggtccactatctcttcagcctcaggctctggctcatcccagggctcagctttaccaatcacattgccgttgcggtcgaggatatcaccatcctcatcaactttgctacccttaaggcgcttggggtcaccctgaacgacggtacccacctgctgaccgtccgaggtcacacggccatcagccccgacgatagcattaggaaagttttcaaagggtgcaaagtccttttgctcatcgcggccacctgaagttagaggctcagccttgccgacaatctttccggcgctatcccagatgtcgccattctcgtcgcttatcttcccatggagtagcttgacgctgccctcgataaccttaccaactacatcgccttttgaattaacaaggttgcccaccttattaactttggcatctttcaaagaaccgtagtcgatcttttctggctcttccttttcttttggctcggctttgccgacggaatttccgttacgatcgagaatatcaccatcctcatcaactttgctgcccttgaggctcttgggatcaccctcaatgacaatcccaatttgctcgcctttggaggtgacacgaccgtcagcttctaccacagcatcaggaaagtcttcaaatggcgcaaagtccttttggctatcgcgctccgcttgagagatgggctcagcctttccaacaattttgccggaatcattccatatgttgccctcatcgtctgatttcttccctagaagctgcttaacattgccctcaatgacacggccaaccatatcgcccttgtcatcaacaaggtttccggccttgttgaccttggcgtccttgagaatggtgaagtcaagtttttcagccccctcttcgtcctgagtccctccttcttgctgctctccttgaacctgttcctcgccttcgccggcttgcgacagttgcatgtcagatccctggatctgactagggcttgcaccggccttcgcatctgcagacttctggtcttcaattacctcgcgatcttcaagctggacaagttcagcttgtgatccctccttgcgggactcgccggcctcagtgcgcaactcgtctgggatttctgaaacagtgtcgtgaaactccgagggagctcccggagcttcagaagcagcatcgcgccgagaatgctcaccagctgttgggagatcttctggcgcttccgaaggagtgctgatcttcaccgaaggagcgccaggagcttctgaagcggcatcgcgttgggactccccaccgtctgaaagagccccggcaccctgtgaaggagcatcaagggcttctgactgaccgcttctgagagactcgccaacatcggtgcgcaactcacctgcaggctggggcgggagctcttggagtttagattgggatttagaggctgcctctgacttggcggcgtctgactgggcgacctctggttgggcgaccttagactggcctgcctgcgccgctgtgccggccttatcactctctggagcctctgatgttggctcctgtccagaggaactttggctgatattcttgccccggccgaatgcaagcccctgcttgaaaacgctggaggccgaactcaagaacccgctagcacctccgtgttttccactctcttggggctcaggagcctcggcggcggtcttttgatcgccggtggtaaactcgcgctccttgtcatcaagagatgcgcgtccaagaatgtcacccgcctcgttgacaacatctccggtcgctgttaccgtgttgccgactaatgatggagcatcctcggactctgcaagtttgccaacggtcctcccctcgtgatcgataatttctccagagtcgctcacgaggcctgtggccgatcgagggatagactcagctgaactctgttgtcagactgagcagcttggaaaaaagaagctgcggctacgtacttggactggctctctcataagcgggtgtatcttttggtgtgtctctgggtgtatcctttttccacccaccagggatggacattgaattgtgactcgacatgatatttactattttcaaaatttcgcgctctacttgtcttcagtagaaattattgagaagatgatttagctgtcgacttaagctgttagcttagagctttacacggcagtcttttatgcacggcatcaggtgtcggaatcaaaatgtcaatgacggtttgagcgcattagacgtcacagcatcaattgctcaggcccttcatcagcatgcgacaattgaacaaccgtttagattttcttagacgtcacctcggtgagtttctggccagacagatcaagcagaaacagtcgttgcttttcaatggcgccgtcttgacgccaccgctccctttcaacagtaaacttaagcacagcactgggctagcaccaaggcccccaagtaggggtctcccagccaatggtatcaggcaaccttgcaggtttttttcttggatatcgtggagtggagacagataagccacgatcgagattccgacactccttgacatcaaagtaactaggaagccgtttcgaaaacagggtttccctgcgcacgcgtcttcagccatcgtcgagatgccacacagccactatgcgtgggctgcagagcgtctcgaactgattacatcagaccttcgtcatgtcgttcatgcatgtaactatgcttggcttccaattactctcatgccttgaattttgttgtgaactcctatggacttttctaatggattcccgtccgaacgccccaaactccattcgctgatgctattctgcagattgattcattgatggctgtggccatcttcctttggatgatccctatacctttcctgttcttcctgtgtcttctccctctcatgctctacgcagtcatggtctcgattgagtatggtagggatcttgataataatctggataccgtcgaatgttgatttaacatccaaatatatcccagacaggttaggcgcagacgacggcttgggtgctgctggtgaagtacacgagcacgcccgagcatgagcatctgagccgtcccctcttgcgctgctcctcgccagccaagattcctttgcctctttctttggcggtttattgagctttccaatcactgcgccttctttgttgtagatgttgccctcgtcgtctgcctgtagtccgccgtcgagctcttggcgccctgcctcgatatagttatctgagacgtagcccgcaatctcgccgtcggtatctaggatctcaccgctgcaagacaccgggcgaccgaccatggacggcagatcgccctcaacccgccccagaaccgtaccatcccagtctagtacattgccaaactcgtcgacgaacttatcctcaagaccctgcgcaagcgtctcatggcgtggcttgaacgacgctgattgtgccttatccccgaccggcagctcacttcgtagtgacgaaaacgggattattcttggtatgggcgtaatcttgggcggccctttgctgttgtttggagaggaaggtcttggctgttgtgatgaggacggggatggagacgcggaagatattggttgtttcgagagatctgcttcagaagctttacgatatggcacctcgaagatgtgcgtcgagtgtgtatagtgagcggaatctggagtgggagcggacggccctggtggtcctcctcctgcccccccatccggccgtgatgacgaggtatgtgtggtagagcagttggacatcatgtcagctcagggtaggtaggatgattagtgggggcgtggtattgtgatagggagaagttccttgtcacactctaccctactgtcgacagatagggaggaaaccagcccatggcctgggttggatggaggtttggattgatggctcaaggatcgtcctactccatcgtgctttgtgcaggaggtgagtaagcaaggcggggcaagtcagaccgtcctttctgaggggtttggatatgatggtgccctggttacacgaaggtttggtgagagggcggtggtcgtcatcatgcctgaactccgcaccaccttaaacaggggtggggtctagactgtggtcgaggttttgaagtccaagccatggagcagggcagggtcagggatggtacgtgaggcttctgtgtcacacagcgggggttttgaaaattgaaatagcttgtctaccatccacagagggtcgagctgcgtaccgctgtggaaagaagaacaagccaagaagcaagcactgaagcttgtgtggtggcgatgtaaggtggcgggctcctgtggtgttttggccaaggagtttttcgtgcgacacctttgacaatcaccctctacaatttgagttcaatagctgccttggtcatctgagacaaagtcatctcattctaagccattgatgtttagctgtattaacagaaaaaagtacacttcatatcgcccaattcaaaagagacaccatcactcgtcccatctccagcggttgaactagatcaggaaaaaaagaaaaagaaaactccgttcaggccgtatcccattgtaagtcgagccatcagcatttctgaaaacaacaagtttggtgtgatcctttattagttcctgaatgccggcaaaggaagtgtgcaaaaacaattagccaacttgctctttgatagatgctcaacaatgaataaagtggctccacgatttgttgattgttggggtatattaaaatatggcttcatccagtgctgtgaaaagggttcaagtaagataagtagccaagcaaaggtcaggtaccagggaggcaagcccagaggagcatcacttagcagagcaactgaaggaggtatgtttgaacctacggatggcatcactgatgcgaaacacggacgaactaacacccacggaaccagctcaccggtaccataacccaaacaattgacaacgcgaagcgcaagattgagggcatgcctcatgctaagaaggagctgaaccccttgtggggactcttgatggagcctctgggccagattctcgcaggcgtcggcttgcttctgaccggtgtgctcggactggttggcagactggtaagttgtccaaagccaactgactatctaggtactcggtgcttgtcaacgaccctgctaacacgcatcgcagctgagcggtctcggtcttggtacactagttgacggtatcttgggaggcctcgggctgaacaagattttgggcagtctaggacttggaattgcatacgacgcactggtcggaaaggacaagaagaagaaataagattggcaaagatgatgtagcagtttgggaaaacaatgtcagtctgggatatttttaacgttttagtgattttgtaaatgttgtatttattattgtttctgtaaatctcgcaattcttgcttgatttaatgcaaaacagtccgtgatgatttttatcctagtttgtggctgtaggtaggtgaaggctggttccatgatgctcctccaataattacaagttaatggataatataattatgaataattctcgaacaagtggtggggcatgtctctctatcggtacttctttccatcataaagggcagaaaaattgccttagcactcgaacttttcttgaccaagccaaacaccttacttattctgtactgcaaagctcctcttcttctgtcgtgggcgattggttaggcaatgtggctcattgagccatttacccctacactcccctacactcccctatacatagtacatggagctatttatggccccttggtatgcccccaactctcagcactcccgactcacggagccaattatagcactttggtgtatcatcgcccccaaannnnnnnnnnnnncccccaactctcttcctctcattgctgttttctgcgtttccattcccgccccttgaattcagaaagaccagaaagtgggcacgagcatcgcgtgataacaaattcctggttagaccagcatgcagccgccagtccagctcctgcttaacaattacaaggcaaaagggaaagtaattaatgcctcagagtgggaagctatacttgaggaaaaggctagtacccaacatctccttcctgtgacactttctatatagttatatacgacttttaccttcgttcctcaagggccctttaggcaaaccgcttgcggtttgcgtctcctgtctcctgtcttccgccccctccttcgttcaatcgtatgcgccacagtttgcgctacagtttgcgctacatatgagccttaagggacaacgccacaactcgtgcgtcatagttttttttgcagcacattcttcttattatctgtagttaagactcgccgcagcttgactaagcttgcagaggacaaaagttgttatcaggatcgtcatcgttgccgactcaaggagcagatcaaatgaacctacttctggagcagttccgacttactgcaatattacatcacaagaatgcacaacaccccgcgcatcagccttcgagaggtgttggtttagtgtatgatatataggatagtgccaaaatcccccggtataagaaagctttaaacgctaaggcgcttgcatggggctggaccccgctctccttagcagcaaggtatggacatgatactatcgtggaactgctcgtctctgaccccagagaagatcccgaccaacgtgatgaagagggcgagacggcactcttttgggcagcaagatgtggtcaagcgcccatactgaggcggcttctcgctacaaaccgcgtcaatccgactagacagtatcaccgagaccagactccgctatacggcgcggtatctagaggacagactttgacaacgcgattattgcttgatacgccgggcatcgagccgaaccccatcaacgaatcgggtcgaactccattgtggattgcggcggcacagggacacgtttcgactgtcgagtgccttctagcagttccagcaatcgatatcagccgttcagacgattccggaagttctccgttcctagcagcggcaagttacggacgcgaagaaattcaatttaggatataataagaagggtttcactattaaaaaagccgaaatatcgccaattacaacctctcctcgaagtatccagttcgctagtcacagtaattgacctgccccgctatagaggactcattttttctcccgggataaagagtttttattaattttgtaggctactggaaagagtgttttagatagcccaataagtatctggcaacaaaggaaattatcggaaaaggagagaatgtgatttaaagctgcctgaaaccacctgtcttcttaaactgctactacagactcacgagaatctgttgcttatcgtctccacacttagatcgtttcgataagctgtgtatttaactactggccggggggatgcagacaactgcctggtcgagctgaggaagggagatagttagtactaacattcaagacaatgaacaccgaacagggctcgttatataccagatgagcaatgcagtacttaggatcacgagcgttggctgcagtgcaactggcctgaaagccagtggaactaaccggagcccggcttgctatttgctagagagtatgtcgttagcatggattaattgtacagatcttaagaaagggcggctcagctcacgtgcttcacagttcaaaccgaggatactaagaagaacatcagtcttgcagcagagaggaactgcaaaaagaggggcggggtaagggtcataattcgcaacgacagaagtagcggtaacgtaatccacaagtgagcggaccacacaagtgaacggaccacttctacctatacctcgtacaagaacctcaattaaaataacaacacctaattatctacaataatagcactagaaattgacttatctgactcctctccagcctccctacaggttcggatattatgacctggcttaccgcaattgccacatcgcggagccttcgtacgagcctgccctccctggccaccaccttggcggtcttcccctcttagctgctcatccacatgcttctggtctaatagatctattccatcctgtatagttagggaccctccaagccgtacacggcttttttagctcttcggcgcttgcttagtgcctcatttgccgtacgaaggtcttggacctcagcacgtaaaagagctacctggtgcattattgcagttgcccctcttgtaaattggtcaactgcagctagcattgatgttggagagctattttgatgggctgagattcgggttttaatatgctcagactgtgcgctcgcctcgtatgcagtctgtggcgtctttaagacccaaggttgccttacctcaggaagggtctccggtggtgttggtgttcgtaataccacatctagctttgaaagaaccctctctgggtcgtacggtattaggccagatccaataaagccagcctgaatattcttctctgtaaaggagtgaaagaaggccgtacgaaaggcagagagaaattcaagcttgctaatatgggtaatatgcatacgcattagaccctcaatctctcgcccgtacgactgctttagtggtccaaagcagccaacatctagtggctgaagaaggtgagaggagtgggcaggcatacagactgtaataatcttctgctcttggcaataggtctcaaagtcagctgagtggtggctctcatggccatcaaggattagcattccatcgcaggacacatccttcagtaggtcgagtgaccacttccttggcaacgatgacaacatcgtgtgctcataaactctgcaccgaattgcactgcattgcggggtgatggtggcaagcggattaaatgactgtagtttcttgtcgaatttattttccttgaattctctccgtcccctgtagccttcccctatcatctttttttatctacatctacagagactacgatgggaacacacctcagcaagcctgtgcgaaatagaataacgcgtgtccgccaacctccatgtcgctccagtgacaaccgaaacacgacaatccgtctccaagtgaatgcccaaaatgtggcagatcgcggaagaaaagggccaagaaccggaacacgattggaagcgccaagaaccaggattttgcaagacaatatgcatcttgccatgaactggaacctatctctgtggctgccaaattcggttgcaacaacaaaaatctatcccatgatgacgcggaaaggaagaactcagatcgcggatggccatcatccaagactaagtcaaggcgacgcgactgatataaaaccacaacctataagcgtacctagaacgtcccaatatccggcagcctccgatcagggtacctatcaccaacacctagaacatgaaacaacgggtacagatgtgcgatcaaggcgtgcatctactagcccggaggcccttgttgctgcaaatgaccacaagccctttcccctgcaagatatacatcccgaaatgactctcttgcttcctggactggaaaaagccgatcgatcgaaggatttcaagggagtggaccacgaagatcacaaccctttcagtcctcgccagacgaaaagtaggcccatcaagtccaccagagatttattcccggcagcaaagggctttgaatacaacatagtttctgctctaaatggttatgtaattaattagctagcctagccacctaaccaagggaatattgtttgttccaaggagagcaaagtatgtatgtacatacatacatagaactagatataaacaaagagtatagattcctgctgactacttagaatgacggccgcgccagtcacgtgacggacccaaagccggtacgtaccaatcagtgagatcaacgctcattgggagttcactttgttgagtgaagtccaagttgaagcccgagtgaactcttggatatatatacggacattcattctctaaatagatacactcgctagttatcactaacactacagcttcctagctacattatccaactctgtaactagcgactgatagattgacctgccgatctccctgcaccaacggaccaacaaagaccggtctatgtctagctaccctgtagctagtcggaccagcttgtcacataaaactatagtttaaattcttaaaaacataaggcaagaagttttatatattccatttttatttaagttgataaattttttagtttatattttagaagggaaaatatgagacgtataggcctaagcttaaccttatgttgtttatatgatttcgtcaagcgctcaaaccgagagctgctggacagtcggtttctctcccggatatacggcacttaaggagacacagtctgtttcattggctgctcgctattaatgttaggattatctctagccggactggctaccatcgtcaacggaggctgttcctcggattgtaaagtttacacacattggggtcccatatctgatatgagcaggagacgggattggctaaagggacatgatgctatcggagggcagatctattggcatagcgctgtcctcgttttcttgaccaatcatgattgggcactcgcgagtgtaaagaccagacgtctgacgtgagttgggctgtttcaaatgtgaggcgaaaacaaaaaaagcctcattgtaagacgcttcctcagttatggttagggaggcaatacaagcagctagctcatcactgtgaggtttgggaatccatcgtcctccgtagagctatattatcaatagatgggtgccttcacatcagccgcgttgcagaaaaagagaaggatagcatcataatcggctaatgtaatattcagtccaggggcaggcactgcacaccatcatctggtgacgtaagattgtgaccccttccaggggaagttagtacatcccagataggaccagcgaccagcgatagcagcatctcttgcaaacggggccatctaagcaccctcagttgcctacggtcccacgtgcaaagatagaggatcccaaacgagagtctcataggctagagacgcatgagagttcttcatcctagtccgctttcaatctagctctagcaattagaggagaggctaaccacgacgagttaaacatagatgggtccagatcgattatctgttgacgattaccggctggggaacgtgacgataaccggcttgaatcagggaagggacagaagcattggaccagtgagaagctggtgatgccagcctgtggttgtttccggagtgtccgcggagacaggacatcccctctcactttttctaccctgcctttttaacaggtcacatcacgccacggcgtgttgctttctccttgcacgctagtttctctccatgcatggccttgtagtgggatgggcgcgtcaagtatgcacatcacctagcggaccagctggacgacgcggagggacgagattagcatcttggtcaccataaccttttgacctaaatcttgccgtgaaacgccccgtccattgagaggcctcgcagatcctgcccatactgtttggtcaaatgggagcccgtttcaaggtcgagtcagtccaaggcgtactaccgttcaatagttacaaggacgacgccgcctttccccagattctactagtgtctatgggacttgttggtgtccgctgtcaaggtatgggtgatacgatcgaggcctggttccgccaagaattgatacagacaagctgggcttatctgaacctggtcgcttaaaaggagagggtgatgctctactttgggctccgtccattctcccgcccatcatgtctatagagatcgccatgaggctacatccgattgattggtaaccacacacacacacactctctctctctctctcgcttgctctctattcagtatttctttatggaaggtgcatttgatgcagtgtcgcgtgcgtatgccaatgttcagctatggcaggactccagactaatgtctttgttggcttcggcatcgtctggacgctgtctgtcctcgccataatcggccgagtcatcgctcgccggatgaccaagattcgatggtggtatgaggactacttttgcctgtgtgcctttgtgagtcgatgaccagatcttcacagaaaagcattatgtccagactgacagaatatgttccaggtctttgcatgtgcccacaacgccctctgcatttattgtaagagagacttgtctccattgatgctatcccacctaactgaccatcgcagggtgcgcgaggtggtccctcggccaaataattcccgatgacatcgacctcgccctccacgacgagatcctttaccactcgcgcaagctgggcttcttcgtctccatcagctacacgtgctctcttggcgcatccaagctggccatcctgtccctctactggcgcctgtttcagtactcgtccattcgtatccccatcatggtcctctttgtcgtgtctatcgcttggctcgtcatgcgtatcttcatgaccgtctttcgctgcacccccgtgcccgcctattgggacgactcgctcggcggcagctgcaacattaaggactcagcctttttctttggcacaatcatgtcccatttcttcattgatgtcattatcctgtccctgcctgtcgccgaggtattcaagctccacctgccccttgcccaaaagtttgccgttgctgcgctctttctgctcggcatcgtgtacgtgtatattttccctcctactcccattatggccgatctttgctgacgggatacaagtgtatgcgtggcatcggtcaactgcctcatcctgtccatcacggccgatgcccatactacgcagatgccgtatgattacgccctcaacgagacatggggcggtgtcgaagttaacattgccatcgtctcctgtacgtctgattcaaacttacctccctgtctccctctgatacacacacatgtacaacacaacctcaaaagccttggaatcacccttgctgacagacatagcctgtttccccctcctccgtcccattttccgctccgttattagctcccacgtcctcaactcgtacctggatacctacacgaccaacgccaccagccacgcccaccgcacatatacatgcgccgacggcgtcgagatgatgaccctgagcaagaggcgaaccaggacaaacaagagcaggcttgggggcgtgagcctcatcgccgacgaggaaaagggcatcctaggggatcccactgcctgcctggatctaaaaacgccagagcccgtgcacacgacgactacgacaatggcagcggcaatgaggcatgggtctggctgcgagtggttcgacgtgcatgacgaggacgacatacgcgtgcagagtgacgtcgtggttgaggtgcatgaggtgaagcgtccagtatcgtttggaagcgacgggatatcataaaagtcttaacgttctctgcatctatctgatgttgcttggatttttctttgtatatatacctaactttaagctcgagcgatgaattcagccatttgcgtgattcgtgctgccacatagctagatgagatgatgtgcaggtactttctggatcgggacgatgcatttgatgacgatgggcaatgatttcaagggtatctcatactcgaaagtgatatgttcaccccgaacatggcggcggaggaagttaccgaccggtgtgcatatgatatacctttgtttcctagtctatggccagtggcggaaacttgctccgtcatgattgccatcgactgattcatagaggacaggatggataagtggcaatgcatggtagagctcatcgaaggggatggatcattgctaagtactgaaggctgcgtcggatccaaactctgacccggcctcggccgcgtggctcgaaagttgtgattgtgattatccgtcaaggttgcactccactttgttaattcgtcatgttctcctccccatccatcccacaactcgctcgtgttcgcacatcacccgccacacgccatcaactgctggacatatacgcctgcgctgaacactgataagcgagcggcccggacaagcgaatggcccacttcgccatagcccaacatctcttgaccctataaaaccaactataacgttatataattgagtcaaatcaatcgttagtgtcttcttcagacagttttacttttatctgacactttcgagcattatgccctgtcttcccacagacaccacatcgccgttgcttcatttctgccttccgcttgtgacccccattttcgcgaccttcttcttgtaactgcatgtcaacatcattttggccttgtaaatcttgtccctgacctacggttagacttcttccttgtcttaaacgcttctttttgttacgtcgacgtcgactaagcgtctcattctcctcccgaaggatctgcacctccgacttcaatagagcgatctgatgcatgattccccgcgttcctttcgcaaactgatctacagcattcaaaatcgatgttggtgagctaccttggtgtctggagattcgggacttgatgaagtccgactgtgaagtcgcttcaatcggattgtttggtgtcttagagacccaaggggccggtaactcgtccactccaaggattggtgtcggcgtacgtagcttggcatcgagcctagagatcacactttccgggctcagaggcataagccctgcgcctcgaaagcctcctcggatgtttgtctctgtcatagaggactggaacgctgcgtgaaaggtgggaaagaagtcctccttgctgatgtagcttgtacccgccctcatcttcttctcgatctgtcggccgtacgcttgcttgagcgggccaaaacatccaacgtcaagaggctgaagtatgtgagacgagtgagcaggcatacagagagtaacgatcttcttctccttgcagtacacttcaaagcctgccgagtggtgactttcatgaccatccaggatgaggaggcgatagccacctgtggttcgcgacttgctgtgcttgtcgaaatgctttacccattctagacctatttcgtttgttgtccaaccattttcagtcgtggcgataacccagtcctgcggtagaggactatcttgataccacgtcgagaggtgatttttgcccgcaacaacgatgaacggcggcacgcaccagccttcagaattgacgccttggatcaccgtgacccattcaagatttccaggctgagccatttttacgttagaacttctttctgcacttgccacgatcatgcctgttgagatgacacccatcataaagccagtctcatcaaagttgtgaatatctggccaggcgatgccatatttggcgattgggttctccacgagcgcgaaccaggcctggataacgtctggatcttcgcactgggctcttttatagtcatacctgcgaaaacgacgcgtctttagctccggtttccgcttgacaaagttagaagcccagcgcttgccgacgggcgacgcgtcgcggtcagcgagcagtttattggccatatcttccacgtcgcgaaggcggggtggaaatgaccgtgaatccaagtcaagaacatattgaacaatcgtctgttcctctaggtcagtgaggattcgcgagttcggggtgctgtcgcgtcgtgagggtcggcccttgagcctgcgcctcagggtcgttcgggggacttggaatgacttgttaataaactgggtgcttgagtttggctcttttttttttagcttgtaaggctaattgcatatgagcttcaccccctgttgatatcatctcggtttgtgggagatagatgtctttgagtgttgataaagacataagacggtgaatagcttcacataatcaatacttcgatacacacatgcttattcgctgcgagattcccctccaatgcgacatcaataataacagcgcgtgatgaccaactccaagccaagaaaatccttgttttcttttcctcaacagcagttctactcaggtcaccaaacgtatcgtgcatgtagggtagttccccaagactgcaccccaagactgcacggggaccaataggtacgcacctgggtgcgcacataagtgtcacgtgctgcgcacccggtgcgcgtgtaaggaagttatgtaagcctaatctccttgtaagccggtcggcagcaagtttcgcatgaattgttttctaatctcgagacgacgagctactatgcagtttctttttgacagtgatataattcgagcttgagcaactttcatatcaataacaatctaagcagcaactgtaatgctatctttggtctggttattgttcgagtatagagcttcttgctcgataatgtctagctcgatgccatctggtcaaagttgtcaaagcccgccgcctcgaccaggttgaggatggcttcgaagcgctcgtccaggggtgcgttcttggcaggcaccctgatgggcggaggcgtggccagcgcgccggccatggtcgccgccgccgtcgatgtcgaagtcgcagggggggtcatggtgtggcagtagctgctgctgtcgggcgaggcctgctgctgcatcttgacggtcgtctcggcctcccacatgtcgaccgccgaggggtcgaacgtgaaatccatgccgtcggcggtcgtgggcgcaaagggcatgcccatctggtctgcgtcctagtcagtctttatatcccaggcaaggaaatcagggcgccttactgtgtacttgcgaggtgtgagggtacgcgggcatgccctcgaggcatactggcggcgagaggaggccgttggccatggacgacgcctgcgacgtggccgggctgtggacgagggcgtgctgcgtaaaggtggagttctcggagtcctcgacgggctgctcgtatagattgggcaggccgatgagctgaggcgggggctgctggtggtggtggtggtgacggtgggcgtggtcgagcatcgagggggacggcgagctgtccatgcgcagggcgccgctcttgggcatgaagtaattaagcgtcgacgggccgagctcgctgggcgtctcgctcgaccgccggccctcgtggctctcgaggcgggcctgtagctcgccgagtctggccttcatgtgatggcctgtctactgttagcaaactatgttgagggcgaggcgggatggaacgggacggccagactgacagattcctttcgacgtacggtatgtgcgctgtgccatgcggttctggattctcttcttctccttggggtccttgacctttgtccagtcattctcctcccgcagctcgccattgcgaggcagcgccgacaagggcatcgtcgtcttcttggccgcggggactgtatttggtttggcgttccacacctctgttgtgaacgacattgcttccgtgccgtgtgtggctcgtttcaagacgtgaaagtctctgatgtgtgtctacgtatagatgtacctggtgtgatggggaatggtctgaaatccagggtgatgttgttgtaaagaggagccaagggagtgaaatatacaaggtcggcaaagctggtgacaaggctgtaacaaacgatggatgattgatggtaatacaatatcgttgggatgtactaggtcgttggctcttctcctggcgaagtatgggcttcagataattgcttagttttcgaagaatacgcggccgttgaaatcctatgcatgcgatcctcgctacggggttcaatcacgattggttagtttatgcgagtaggcatgaccacacatcagcactcgctcgctccggttcgtattgcttaattagtctacactaaatgctggggtgtccacccatcttgtcacagagactaaaaatggctcctgttaggcggggtactctatccaattaaactgcacactgtgatcagacccactaagtgacttccttcataaatataacagagctataaagcggacgctgaacctgtacagtatttcattgtagaatgttaaagacagttcgttcattatactgtatatacccataacctgaacatcactccgcagtggctcttaaagatggatactactgctcctcttacgtaattagcgtagagctggcacaacatgtctttgcaattattatcttttgcctgtgggtagtaaattctgtgatactgttatgtttctggggcctagcgaggatacacaaagcaaccagcgacattaacagcagagacaagcgataaaagagcgatattatatacatggtttatggaatccctactcatgttccgcaagagataaaatggcagtcagatcaaaattgtggtatattttagggtttcctgatgatggggatgataagattttgtccataaatggcgcctggccgctgggaccctaggctgtttaaagcaatgtgcaagctttagctgtacataacccagaggagaatggagttagctttgtatcccctcctataaaataatccccgttgccgctcgtgattcctccctaaaacgaattttcttgtcttttcccccgtccccgcagagaggtttcttcgagaacaatggccaatctttcacaagacgctaaaatactcgaaaaaagaggtgatcttctcgcgagggaattttacgcccgttagcatcacctccaaacttgacactggaaaatcccgtacagacatagtccccccgtcgcaacgcgcaatctaattcaccagctcaatttgccatcatcgtaccaatctatgccatagagggtgggcgaatttttgtccttaacacggcaattccgcgcagcaactgggaaatactcgattgcttttccggcaggcaaaaataactccaaagacaccgatgcaggggcagcagctggacgagagcttgaggaggaaacaccctttcaagttgacgactcgaaaaagctgaatgggtgctatagtctttcagcttattcttctaatggatgtttggacgagatgtttgcgatggttctgacctatatcaaaccaaaggacggcactattttcacaacgtactctgcccgtattcaattagtgagacaaggaacgaaatttacggagacagagagtatccagagcttcagtaaccatgctgaaagtttggttacgtaattggaaatgctactacaagacaacaagtataccatggatggtcgtttgatgtaggatggaggattttgagcccagatttcgagttagttctactatactaggtttcatagctgtggttctaagaatcgacagttcagtaggtaaaattggttcattttctgaagtcacaggaaatcagatgtgcaaggttagaaaataacaaagggctctattgcaactgacagtccaacatacgaaattactggctgatacctgctagctctcatagcctatcgagaaatagtatttcgtttctaatcagacgctaaaagccaaccaggtttagtttgtctcttccgatttgctactacttattcatcctcttttcttggaggagattgtccacccacttcccacagttttcgactgcaccggccggggccttgcggtatctctgaagataattcatgatctctgccgggctaaacttgctatctggaactcttccggcaaaagcttccgattgttcctccgtatcgacattttcctgacccccaagcatataggtgaacatagccttcgcaatggacttactagcgagttcaaattcggctttcatatcaacgcgaccaggcctaataatcgctttatcgagtttgtgaagatgattcgtcgttaggataaaaattcgattaacctgggatgaaacaccatcaagggtgttcaaaacgctggagagagatacccctcctggggaggatcgaatatctctattattgtctggttcagaaggattggagtgttgaggactagcagctccaataacgtcgatatcctccagtaatgcaatacatctttccggaagactagcaaataaatctttcaggtttcgatcgtctatattcgggatactaaatatgtaaatattcatatccaattcaccagcaattgaaacactgaagctcgttttacccgtccctggagggccgtaaaacagatatcctcgtttgtacggaattctgcgatcagaataccaacgcctagtctcagggtcaagaaactttgtaaggtcttgtacaaccgtttcttttaggcactcattcagaataactgtcgaaagaggtcgagtatcaactgtcgcatcaatcttccaattattgccctgatttttatagattattgttttatttcttagtgttttcagatactgacggtggcactctgacataaagtcttttaagatagaaggagatcgactgatgcatgaaatagagactttctcctctatacggaaaccaagatctgtatgtgtagttctgtacataagtaagttcttcttataccagaaatagaagactccctcccaggggagatagctgagtggtttcttagagtaagcattaaagctatcttcattgttttgtcttgctcccatagtgaccagaacggatcgggcagtgcggtctgatttatgagataaaatccagccatgaaccatattgtaagtttcctcgtagggcctaatgtgaatcgtccattctttaaaacataaaatttagcattcttgacatagagcaagaaacggaaacttacggaagaattctagaaaccaatctctcaattgaaatagatatggtttcgagagagcaaccaacacgaagaggcatagaatttgagtacagccactaagctggccactaaagatctgactgatagcattggaaataatggcgaaccctggaattaaaagttctaccatgggtagctgttgagaccctgcttccagaggtatttggcttccaaggagcgtcatggtatgcgaatagattgaagtactggtccgaggacatgacaagggctacccaatatcagattcgaaaaaggcgtacaacaggatgatcctacttttttgtacgacttctagtcgctctccaatgacgttgggctctatatgcaaaataatctatatagtatgtatactatggagccattaatggccaaaaagacatggcaaaagtatagcataatcatcaaatttaagccacaaaggcagaactagccattagggcctatggcaagatatatcatattgcgtgcggaaaggtgtttattcacggcgcggatctcatgttgactattatatcaaatgacaagcacacgggatttcccgagccatttagtaaatgttgtcattatcaggtgtggtggtccttgaaccaacaaagctaacccttgcagggtgcaacacaagacagtcacatccagaggcgaagcaaaatacatttatatcacaaaacgacgtcccgtggaacagccaaattctacagcatagacttcaatctcgagagcgcaaacaaagagacatacagggtcgaccgaaacgagtgtccgcttttccgtgttctatttgaaatgaagggcccaattttaggagcgatgtggcttctcacagtgcggatataaaagatcacagtgattacaatgtacatatgtaactgttgtatttgtgtatacctagctggtccaaaataggctttattgtgcaacagaatcagaccctaatagttcaggtactcagtggtccccagtttcattttctcccattccttctaaagtcaattttagctttttctaagtagcattctcgaggtaaccacccttccaagcttccgtggggttgtttgaacttgatttattgtttattattcgctagccccatggcaggtgagcggggctggcagcccaatgagaggccggattgggctcaccgcccgatcggctccagctatgctgtctaccccacactcaagcgatggtacgcatgaggtcatcctctactgctttatgctcgtccatcactataaacaccgagctcgatcctcgatacacaagagtactaagtaccaaaatgccttcgcatgggagatttgaattatggggcaatcgtcccacaaactgggagccaattcgtttggacgatggtagtgaaagcgatgaaagttttcgtcaacgactgtccgaagccgaggaggaaaagaaggcctatcgtcgccttaatgaacttagcaagagagttagagagaagattgatacccgcttatgggcgaccatgtatctccggtatttaatgaaacggatacacacagttgccccggtccatatcgaatttagagatacagatttaccgaacattaaaaacctgtcactgagtgacgaagctctcgctcattctccggaagaacatcttgaacggccatttcaggatctgtcactagagattcaacttcaaatcttgaagcggcgcctgaaggatgctcacattggcgtagaagctatctgggcaaccttgaacgaactgatcgtcgtattgaccttaggtaaataatcacagccctgaagaacgtgctttggaccactgatggctatagaaatatccgagcatccgccggatagccatattggctttagggtcttcgatcttcagagccaagcttgcatcttccctactggagatatccgctgtggaaattggcaagactttaatgtcaaccaagatctaacgcgagcgggggccgaaaagcacatccaatgtttccccagcccgacggactacatatccctaagcacatcaccacggcgtctctggaatattgtaactacaaggatgtctagagaccaaaaccagaatatcgcggtgattgacttgcgcgttcttcaaagacttggcatagcctatggcagcaccacagacgacctcggcttccatagcaatgagccaaacaaaactaagtatgccacaaagcaccatgttttggtgttgggatggattccccgtcacagtatattagggtttctctctatagagagcttccatgagttgctggaagaaacacacattgatacgtccacggaaacaggtgggtcaacctagcttgtcaacattcgtatcttcagcctttaaccctagataggcgatatcccttccatcgaatatgataggaaaatcccgtttgaattgatttcgaggcagttgcaggcctccgccaagcagatgatcaggggtggagtgaagcaaggtattgcactctaacttgtgagcaacaagtatatacatgcgcataatagaatagcatacataactattctaaaaaggaagagtgatttcgataacttccattgtgccgcgtgttacatataccacagaaacatcaggtattcaatcggcctctaacgccaccgtcctctcatacttcttctactaggacaccaactcgaacctttatgacacaacaacgatgctgagaggtctaaccatcctcctcgccatccaacagtcgtcgctcgtctcgcgactgcataagaagtacgaagaatctggtgccaaactcttcgagcacgccaatgcgttcttcgccctgcccgagatccttagtggtatgctacaagatgctagcctgatgagggtataaatcatcatgaacgcactcgacgagtgcgagactggcttgcagcaacatttatagaatcatcacacgactgctcgtcctctgtggccaacttgtagaacaaggggcggtcttttcattcaagaacggaaagaactgggaggccgagtggcaggaattcaccaatttcatttccacctatatacttttatttatccagagcatcaggtcacatactatcctatttacacttaaaacgttttctttttagggaaaactaagcttattagactcactttccacgtataacggcgaaagctccgccgattcttccatcaataaagtataactaagcatatttaggaatcgtattggcttgctcttcaaggaggccggtgttgtgatataatgtaccgcagatttgaaaacatcccaagccatttcctgccgcgccacgattagtagtattgcattcaattggtgcacaatgaagcctattttggactagctagaaacatgcgttgcacggtaggaacactgtgctagccacatgtggcgcattggagcgctaaaatttacaacgttacataacccgaaaaagcggacactcctttcggtcagccctgtagcaccaaagggctaagaagggggaaggttggaaatattgtagttagcatagcgtataagaagtaggagttgctgaattatgtagttatgcaatgatttttcaacaagttttctaagctaatcgtgtcgtggagcgaataatagctttagggtaaactattttaccatcttctgtttgatattcctgcctttgattgtcgtaaaacatcactaatttccttgcaccaacacgcaccacgataaactcagttggcttgtttccagcgagacaaacatctcttatatcaatcgcctcttcatttctgtgcgtccaggttatatcatttctgtctttcctccttctagttcgttggataagttttacttgatgccctatgcgccctctacgttccctaagcttatatggtgttcgacattcgccacacaaatttcggcattctgatgtttgggtttgcgtttgaagacattcatcacagtagctatgaccgcatggtaaaatccggatcaccctcttgctagtatacgtgttgtagcatataacacattcgttacgcttgaaaaacttcgtccgagtttcgacgcacttcgaagaacagtatagctatctttctttagcaaaactcgataataaggaaaagtaaaacgaacctcccgtaaggattgatagagagttttattttcatcaagttctttctggcatgaatcacaattatccagcgtaagatcaatatacttaggtggtaacattataagtttaacaatttagtttttctaggagttatatacctaatataaattagttcttgttcttatgtctagctaggtatatatatataattataggctagaagtagctccaaagagtagtccctttaaatatgaagccgactttagctttaggctaaatatatagtaataggtatatataggctagttactatatctataagtatatatttatcttaatatagtattataactatctgatttaaaatatacagctctagactggagtaacagttagattcttaaaattatatataaatataacagcctcctcaagggtcttggctaagccttaggcagccttagctgcaactctagagtaagctctaacagaggcggggggtacctatttctaggctaagtctaagaaataggaatagagctgctttatctctaagtcttaacttatataagaatttatataaagtgtattttgtgataaatagtactgtgtggagtattagttgatgttcaaagtatataaaaaagaggaagccggttatactacatgtacttcctaggtcttaacttgttaaattccaacctaacaggcgcagctatttttaacttattatctaataccaccatgataattacatttaagagggaaccagattcatgtgtttagaatctagctagctgagacaaatgtcttccttatctaagtttatattatcgctgccgggagaacttttcgattcaatctataaccttgtgccccaagcagccagattagcaaacatagaaaaattaaagtctcaacaactctctttccattcagatttatggatctggggtctcctcttcaagcctgttaatgaagttaatgaccactggtttaatatcgttcaagagcaaaatgaactacaaaaggatttttattttcatggagcaattccgattttgcttggatcagacttagagaagatcgacgacggttatgacggcctggaacttgttctattggcaaatgattggtcaggagatctatactatcgtcggggttcattttttaactcacttcaaccccatgaatataacaagcacacccaggaggtttactttcctcaacatgggatcaccttaaatatagcagatatatttggatcagaaactgtcttggttaagaacccgaagtcttattttcaagtggataatgatcagttatatacttatggattatattatgatgcgcaatttacagagaagatcagggatatagatagtattcaagggaggaagaaatggggtatagttagtacaatatgttcggttaaaactaaatttggagatggcacgacatgttatcgcattctcgaaaatcgaaggaagcgcctgaaagaaccatacgaaagacacaagattcgggtggacggacgtgattagtatacgagctggagcaaaccaaggcagcgctgaacactttggcagtaatatacagggttttatagttctgaaagatcgcattatttacacaaacttagaaacaatgcttggccctattaacgtaccgtggatgggtgacgttcagggaaccctgatccacaagtctcgatactgctactctgaagacgtgatcgtacgattgttggaaagaagaaggtatcatgccgtggattgcatcaagtatataacctaatatgaagcaatctaactgtttttgagcaatccttctacttctccaatgaaactataactatatgtctagctagtagctggacctcccgctgaggctatctcgggtggagtcccagggaagcgagttatataaaacacatgaaaagaattctcatccttaagacaaatctcctattatctcacccttgataatattttattatagattaattaaattgttattttaataagtaataacctaaaaactaataaagcgcttcagtaataacactattaaagggtgctgcggtccagtgtttcaagatatatatatagtacttatttacttttcgtatatagccttactagataagtgtgacctataacctcgtgcctatgggtatcgcagaagcagtaagggaataattacatttgggcttcaggcgcaattccatatatcgtttgccgcgaaatcattccactaacttcctgctggcaggcttccatttgttcctgcgtgtctgtatcatttgcagggtattctctatccaaccctagagcaatattagctaggatagctgaatatgtatcttcctcagtattgctaaatatagctgagttttccatggcggccttagtcccttgtcgcatgatgtcggacgggctcccagaattacctatcggagcaaaggttggagattcagtagcttcatccgcaatcatataaccggatttattagcggtaatattctcttggggatggctgagatctcgcctagtttgactttgcgccggaagtaaggatgagcaagtggtgaggttcatgtcagatatcgttgcttctaatagattatagggggtgtattcttaatgagggagagacgatgtaattatattgttttaaatcgggtggaaatcctgctattatatattttgcgagcaaggggctatattatctagtctgttaatcttcagccagtttggcttcgactaaaatggctactttttccgagagaatccattatatctattttagctcttccccaccacgatctattacagccagtttagctactttcctttcaggtatcaggatccattgtggtcagaccgcccaggctggcttctatatgacaacaaagtttaactattctctagccacagccattgacccccgccccaaccagcctagctcgcgtaggaaagcatttaagactgaacaaactaagctatacagttataggatccccttaggatatatcgttaggctataattattaacactctttagctctagattatactgtaggcggtagatacacacaatggatttaagtctctctcttgtgtctcttgggcgacggttctatctcgtattgccttctattttccgtattatcaaaatccattagttgctgtgtgcttagcgtcgggctttctggaacaggctctggagctaaatagggggcttcggggtcctggacagctgtcctactgccgccagctatcatagcttgaatatatgcattctggtgttcgatcacctccttctgcatttgaacgattaaattcattggccgaccttcttcctcaagtctgcagttttcttgctcaaggtggcggatctttgcctcgtcaatatgccttttgccctcaagatagcgattctctttgttgatttcgtccatgcggcgatttgattcattccgttcctccgtgtagaaagagcaagtttgtttgaattgctggttctcggtcctcagtgaatggacctgctggacaaggcaattcaggcagtgcggggtagcactagaggtgtagctcaggaatgacatatttcgtgtaacgggtccgattacatttcagtacaagtacaattagcagggttttatgaagaacggcaagtgcctaaatatggatgtatcgcaacgatcaacatctgctctttcttttgcagcagcaaaaatagctcatgagcaagtctgaaccaacattgaagttcacactttaggaactaattttatcgttacatagtacttggccatatatgtacattgcagtgtgtacagccttcatgaggcagaagagttaaatacttgattttgatataccccgagggtaaggtgtaatttgcaatatagaacatgtggtattaaactctaagatttagcaggaaacccttaagtctctagcgaatagctcctttatatactcaataattttacccagtagcacgaagtactgctgactattaagcttctctataatattaagcttaagcttattagaataatatatatatctattaaatctctaaagataagataccctatatgtaaccagtttctcactatagtaatctttcgcctaatttattacaattatcttaaaaataaagagttattctatatgttctattcttcgcagcttataacttgactagtaataatgaatttatcctgttaatgaataaatcggccaaatatcacggcttaggtttacttcattccagaaaaatatacactgtttcccatcttcctcagatttatcaggtatctgaacgagtgccatgtccctaaggtcttgacccttagttttatatacacctcgacgaccatagatgctgaaataaacttcctgcttatcccaactaatatctcgagatagaatcatcattttccacataatacggctaatattcagagtaaagtcttgaatttttacttcgcaaggactctcacaagctgtgtgcggatggagcgaatttctaatcacgccctccatatccacctgttcttcgccctccatatccacctgttctttgccctgtgagactaaaatgagataggcatagttttcattccgatgaataagaacagggaggagcttatagatatcaatccaactggtctccttgaatattggcgcccaaatagatatagaagatagcttctttttcgcatgtaggtgggaaagtgagaagttgaaaatagtcttaggatctcttaagttctgagtaatcatatgccagatttcgtttggaaacattttaattgatgtctaaattatatatggtcaaccgaaagaagtgttggctttctctttctatttaatgatttgatgtttagaacctcacttcagctataaatggctgaaaggatgttcctatagtcttttatatatttataagctagtctagaaatagctttactaggtaggtatatacctacctacataccaagacttaatctttacataatactgatacctatataggtagtaggtatacagtaatcaatgctgttatgtagaggaactatacagtagactcttctagagagtcttaggttccttcttcagggctgataaaagtgcttgtctatcctccttaagacccttttatagagtgagttgcttttgatactctatatcggcgttgaaattggccattaattctttggcttgattatcatgatggtgcccaggtagtgactgagatctagctctagcctagtctggatgtatggtatttaataaaacgagctgaaaagagagatgaagatcgctgacgagcgcgttacgatctctgcgtgatgttgtcttcgttactcatgactagtggagggcaaattatatgttggttacgaggtttagaagtactgatagcaatttggctgaggtacaaaaagatggcttgcatccatttttgggcgggcactacaaggactcgctgaagctgtgggtgaacccgggagcctaaatcatcaacagtggcagccagctcgtcgcggctggggcccctgtccagtgcactgtaggaattgcatgcgctcggctttgcgcataacgccagccaatctcagctggacaagaatcacctatactttgatacttgcgataaaaaattcctttagtatacaccttgggaaggatcctttttcttttagtacgagaagagtttgattctctgtcggattacctaggtaactgatagcttttataagtaagagctaatctctattgcttgcgtgggatggtctcctataagcctaaaatatctcacggaagagtatcgactttaataccttgcgaactcaaagaactaaacgactgtctataggaatagtaatcgcggatgcgctgcttccccctccggtttggcggcctcccccaaacaggcaaggtgcgcacgctgccgcacctcgtcagcgtgatcacgtgactccttctatataagacgaccacagccctcgacgctgtgtagatgtatctttgacatttcttctctcccaccgctccgcccttgcctccctcatcttgcatccgcctctcccgttatttcccttctcccgacttgataacgcttcaaccgctggcctgttggaatggctatgctcctcccccttggcatctagaggaggtagccaccatactcgatggtagactgtgtgaagtagaatgaggcactcgaagaggagatcaaagttcatattttttttttattctttcaatctattccggtctttttctgcattctttacagctctcgtctcttctgccatcacagggtgctcatgatgccccaacattctgacggtgcatatccgagcatccgtttcatggcgctacaaggccttcaagcaacgcatctcgccgcggtacttcttcctgtgaggcctccgagaaacaaccagccaatggcagaaatgccgcagtggcttattataacccctgacgcatgaacgacggagtggacggggtccgagtcatcgccctgctcgagggctgccagggtatcagcagcggcaaagtcgtgagggtgtcatgaaaatggtctcttctggcatggcgcggagcctcagcttccgcatcgtgctgactgatatgtcactgctgcacagtcggccgccgttctactacaagatgagggcgggctgattcgaaagggatgaggagtcccggtcagctctgcacggctggcggcctcatcccctgacctctccagtagcagaaataccgcaatgctcaccaacagccctaatggcataatggggtacggtgctatctcgggctgattgtcgaataccgagcgcagttgttccagggggcatctgggacaaagaggccaccgattggctcgcagagagtgggcggagatcgcggtgtaagaaactatgacgcggctggtctccatctccctgttcaggggcggcaaacacacccactgctgagaaatcttccctcgatcactacctgctctttctgggctcggccgctcctgtgcctctcgcgacgacacagcagctgtgatggcgtgagggatcagcatgatcagttgatgcaaagctgactcggttaagcgaatatggcgcaaagctcttgctccccctgtcaagctgagttgtcccatgccgttaggcggccactcgttggccaaaacgcaggatggaccaatacgaaagaagggcaatgagcctcgaacaagctctgcacagtcggccgcccgctcatcggcgtgggcgcaaggcagcacatgtcagagacaaggatcggtgcccaagggggaaagggtcagcgagttcgtatcaggttggtcacagcaggcagcgccgaggttgagatactccgccactatacgtgggatgcgacctagcagcttcatggttggcgggtgcggtggggtgtgcgtatctgggacacgaattgttgtgaaggtctgaaagcacattcgcgcggagacgagaatatgggcaagggaaagggggcggaggcgcgtaattgggggcaacactagccatctttgcctatataaggcgcccgatgccctcagcaaacgagagtcctgagggcatgctggtaaaccttcttcctcatacaatgggaccctttgtgaatcttgacaacatggttacctggactcctccagctgttcctgattcggagcgtgccgatcatgcgaaacagcagacatctatttcctctccagagccctcccttcccccaactcctgcgtcagctccctgcgatcaagtatctcatgaaccaatctacatctcgtctgatgatgagagtacatttgatgcatatgaagaagcgagttgcggcggctctcaggatatggcaatcgttgcatctatcaagaagagatcatctgttctgtcacccacgagtaagtgttgttgttgaggcatgccttttacaaaagcgttcgagcgtggctgacaatcctgtccaggatctcctaatgatgccaaccagccacagctacttgatccaggtgcgagtcggccaagccaggaggctacaacagatccggatatcttgctttcccgcacactgacgagcacgcaagccagcagtgctgtgcttggccactcgtcgggtagtcccggctatactgggctggtcaccaaaggtgatgctatcataccaggccaccttccggagacgctggaggcctcctgttctgagagctgcgaggcttccaatgctatagccatttcacctcagaacggggtggagcagacacgagatgatacacagagtatactaggaatctgttcggagggtcgctccgattctcagtccagctccaactccggcagccctatgcggcagcgcagggaggacagtctcataccattgacttcagaatcgttggacatccgcgaaaaagaggaaacatacggcaacgcagaggaagctatcgatgatgatgttagtcagcgcctaaacggacagcttcgctgcaaggggacacacaaggaccgcttctcccctggccaaggcccagcctcccactgcgagtttgattctgatgtcagctcaagctttggctctgatgctgctgtacacgatgacgaggactattacccttctccttgccgtggtaaacgggaacaggcaagcaataattctgtcgatgatgaagcggacaggtccgatcctccccttccatgcaaacatcggaaattgggcgggtctcagtccagtcccaggccacatcgccgcagcaaacgtctcaccaaccctacacaaatagtcaattcatcaggactgcgcacgccagtccgtagtgcgagctcggtgtcatcacatagctcatttaccgcagctgatgaggaaatgccagctgcaaaatacgaggaatggcctttgcaaggggccgcgcttaaacgcttggtcgtgaacggtaaagtgacctttcaactggagttcagctgggagccgtatgtcggtggccatgcatcgggctcacatagtggcaacaaattccaacctcaaatagcgaagaggtcacaccgaacacagcgaagcccgaccagccatggtttcactagtgaggaggatgatttaatcgtcaaattgaaggaagagcagcagcttcgttggccagaaatccacgaaaaattcagcgataaatttccacaacgacgatctcagggaagccttcaggttcgttactgtacaaagctgaaaagtggcaaacgggctgagaggaagtctcggcagggccaagccacgagataagttttgcatgaagaatcatccaaggccctatcaaacgttatggtgcaggctgggtggggcctcgagataggttttacatgaagagtccaacccctatcaaatgttcgtcaaagtagatggtataattgtgttgccaaacctgtttctaaccacatttttctatttggttccatcccggcccctctcgctatcctagatgtctctgtgctcattaccgttgtgccgccttcacttctacccccttgaaccaccccacgtgacgtctaattattccacagctttggcctagacccaacttgaggatggacgctgagtatgtgagatgaggtccaggcttgtttatactaagtactagcgaccattgtggttgggttccgtataggcctttgccacgtactatgcgtggtccctccccttctctcacaaaacaccgacccaggtacttgttacaagtcttcggctggataggaagaagttagaggtttggcaaggatataacctcggctatgatgatcaccgaacggcgaattgagactatccgaggaggcggcctcatctagtaaggtgataaagtgctttcaatttcgatttcaatggacattgtgataccttatttacgactgtaaaccctcttctcatcttgttctagagcattacctgcccaaaggtgtcacattctggacaatccttaaaatccggcaatgcatctagccattcttccgtccgttgtcggttttgtctccgctccgccgaaccactcttctccggcacgtcctccagcccttggtcaatgctggggtatgtaataacccagggatgcgaatatattttcttccccgagacctccatctggctactcgcccagcggaatatatcgctgattgcttgtctagatgcaaaattttttccaattaccggtggaggctctccgtcatgcttacattttaaagcatcttgaataactgggatctctttgccaaagccttgatctacctgcttttttccatttaccaaccacgtccagttaacataaaaccactggtgccggtcgcactctaagtgagcacgcacagctaggtctgtctcgctgctagccatactcccaaagggctgccaagggctaaagggaaggtttctgaatggcacaccatctggattttcattatcgctcgagaactcgtgtcgcagacgccatacatcagcccgagagacttggtcccctctaaggtaggggccagtaccataaacatccatgaaagactgaggagacccagtccaagctgcgacctcttccatcggcctacataaggtaggggtttttgaggtaatcaaaaaatcgataatccgattgaagatagtagtccgtccacaagctaagactccgtaccacaatggggcaattcttgggcatcgatatgcgaaaatgtgagctagtatctcacaattgccactctctataatagggctgatgacctggattatcggttcataccaagcactgacaaggttacaatcgatctccggctcccaaaacacactccagagagctgaagaaaagtactggggattcgagctaagtgacatatagcagaggatattatcgaagtcttgttgaataactgggatagagtttggtgtgaatgttgatgttctggatgctcttgtaaatggtgatgtttttggtaattctattgttgacattgttttgttgtgaagtggaagagataaagccatcgcgagtgcaagcgatgattggctgctgatgttgtaggctgatgaaaaccttgcaaggtattcaactacttgcttgcttgacgggggagtacaagtactcggattgatatcatccgaaatatcggccacgaccctaaatcgtatgttgccccggtatgcaatgaaccatggtggtagcaccttgcccgctggcagccatccctggccaggggcgatcagagcattccaccaccgccactcgtctgtagacacgtttccaatgtcgatttccaaggtctgctcttggcgttgtgacgagttgtcaggaataagttcagaatactggagctgtcttccttgcctctcgagcaaggttgcacagagtatgtatgcccacccaaaaaaaagtaaagatacaccgttgagttgagaatgtggatagcggaagccttgctgacctgatatcgaacaaatcgtgggtagccctgatggtagctccagccaccagtgccgcgcttctccttgtcgatttgataaccccctcagacaccctgctcttaattcccatgttgcatagccgtgcaggtcatcaaggttattcaactcttctggtaaagccggcattttgtgcatatggtgctcaagtcggacagtgctgtcactcatacttgcggactttgctttccttgctagagcactccaatactggtagctgcgcgacaaaaccgtcgccagcctatgagcagagggtgctatagcggaacagttgccgtcgtccgaactgctcgccgtacttgccgtacttgtcgtacttgccgtacttgccgtgcttccaagatgtgatagcatattggcaagtatgtctccgccgcatgggatgtcgctaagttgaactttcggaaaaagtatgctctagatgtgggagtgcgctcgaatggattgaaaactgccttgaacttccagctcaaaacggactaatgcgtcacagtggcaccagagaattgataaatcggatcaacaaccccctgggcttcggctactggcgtttagattgataagcagtaagtcatggcaaaattaaggaagtggctactggacctaccgagagacgtctccggggatgggaataaatcggatccaaaatgtggtctatcttaaggggccagacttttcttaaatagcctcttccagtataggctgcttcaatagtgtgaaagctagacctttcaagctaatagctcaagccgtgatattcgatgttcaggtgcattgggtttggcggtgcctgagtggatactcagctgggttcaaccgggtaactactactagcacgtgatcaataaatcatggcgctagtattaacggtatcaatactcacagggaggacttcacgtcagctaagtatacgataatgctctattcttacccaactccgcacagagaatactggcctcaaagacgtcttattcaaccgacatattccgggtgttatagaccccaaatgcgactacggaggaaggtgacaaaccgtaatacatgtcctggtacaatgccgaagataccggcgctgtcgacgacaactattcgggccattcccaggaaaccttcggagaatagtcaatggatgcaaatcagccttcaaggccatcaacaaacacagatactcgtacgattcaggatcgagacctaactagacgaagccctgcactggggggagactagatatatgttagacgcagaaacgaggaaaccgcctcgtaggagcctgggggcgcatgtatatcagtattagaaccattctccacagaagctggcggacggatacagatagaggttgaagaggaagaggcgagaatgcttaataggcatagctgtataactgaaaagcggctggaaccgagtaggattaaatcaatcaatgaatttcacagggagggcattacctccagtttctatgatgccgcccttttccacatcccaagtccaacaaacatacttctcatcacgatatacctcatttaagcgtcatggtgccgtccgatctctggaaggcgataaagcccagatccccttgtctaatgacaaacgtcgccgggttattgcgcgttttattcgagaacaccctcagcgtcctcttcacgtgttcaagctcgttatgagacgggcgaaacttgtatagatcctgggagcgagagaagtgggtgcggtgcatctagcctgggccagtcttgcgggttgtcgaccagcgtggatttagattcactggtcacgtgctatagtgttttttccagccatatggagactgcctaagctgtgatatcttatcgataggaaattggaggattgactgcttaacaccatcacggaattagtggtaaaatactgagtgcatcctttgcacttcaaatctccattggtacgggtcttagaatgctagggagaaaattagcgagaaaatcagcaaactacgcaagaatcgtagatctcaagtacacttcgtttgcggactatttccagatttgaagttgaattaaaatatatattgcatgtcttatatagatcgtgctgatccacgtcatgccccaggactttggccgggttgtcgaacgcgatctggcatatccggctctctgcagctagattttgagagtctgtaggtggtattgtcaataaggattgagatgatctactaaggtaactaccacagtctgcaaatctagctacagccaattaattgtaaatataagcaactttatcttattatacggttcaacgttccgccaacacctttggatccatccgggcatcgtggaggatcttcttcatcgaggaatagagctccggctcttgcctcttccatctcccaccattaggaaatactttccttcgcagcctattgacccatgggatcagcggccggtagtacgacgtgaaatgcttgtctaccttcttgagaaaatcttcctcatccgcgatctcgcccttcttcagttctgctaactcatccgtatcaacataattccatttttcaaatcgcggcaccggcttgccgtcgttagggccattgtagtgaatacatatccagaacaatacccagaagaaggactcaagatcatgcatgaaggagtgctcatcatccaacagtgctcctatagccataaatgccctcgttcctgtctttccctttgccccagaagcaccttctcgttgctctcggacagcaaggtcaaggtcgatcaagaaggctgtcctagaggggttcttttcgtcctcgttcatcatgaggttgttgatagaaatgtctctgtggagaaggcccgccttgtgcaagtgataatggccgtcaatgcagccttccaccgcagaaagcagcgctacgcgagagcttgctttatagattggttttccgtagtcgctaaggataactcgccggtgcatccggtttggtggtcgttcgccgcttgcctttattggagaagttggacgggaccgcttaatcggcggtagagtggcgtcagcatcgctggatggccgcttaatgccagcgctggtgcttcgccctttgcgggaaatagatacgttcgtactggactgtagcgtcgcacgtcctggtcgatagttagcagcttctgtgacgtccaggcactttcgaatgttttgttggatgtcgtcattggcacctcgtacgcgaacggtctcatgatggtaatatcgggcaacgttagcaacgcctttctcagtcgcctctcggagaagttcgccttcttcgtcccgatcagtatattgccacgagtctttgataacaagcggtgtctgcggatcctccttgcgatgagctctccaacagacagtcgcccgaccggcaacgcaatgtgctcgcttcatgaccttgtcaatgatgaggcgctctgttttgccgtgtcgttcaatgtcgatatattgctcatcgccagatgctctaatggtagggtcaaacccaagcatctcctcgttcatccgtagaaatccgaggatggtcgtcacaaactgtagcccaccagccttcttgttgatgtcaaattgttcggaggcgattcccccaagccggtcgaactcctataccctcataagagacccgcagagagtaaagcccagtacgaagcgacgagtctcttgggccccgaatacctctctcacataccttgcaagatcaatccatgcaatcgactgtgtgtccgccttcgggttgcttttcagttcgccggcaacgaggatgtgtgaccagcgatatctcgaatcttcagagtcaggattgtaagtgattccactgttaacaaagccgatatccatgctgcgtttgcctgtggagccaattaatggagtcctaggctgcgccaatagcttgcgtcggggcgccactctcggatcgtggtcgcttgcgaatgcttccagcttgggtatcaagccactaaaccaagccagcacctcgctctctttggcggttgctggccatccagtccaaccatcagtgaacagcggatggtcgccgtcggtgcacctgcgaaaaaccgcctcagagactctgtcgaggtctggcacgtctccaaagaaggctttgtggaaattgggtagtccagtatagagatgctcaagctccaacttaaggatcggatccacattctggcgaaattccgacgagttcacgaggccgcttgtattctgactcaacggcgtttgttggatcgacgaaggtattggtcgaggaggcggggtcgattctgtaacagcttcgtagagatgattccagatgatggcatcgtctagctcatcagcgagcgccgattttaacaagggtttgacgcggtcaaagtcgaagtcatccgaggcaacagcagaaatgagtttgaggagatcgtttcggagggggccgtggcctgtctttgattgcaataagaggatgacggggagttttcgcagaagggaaaggagatcgagagcgagattctggatatctgcgcgctggttagaggagtagacctcggcgaagtttatataccttaccttcatgggtaaagtgggcaagcggatcaggcgagtgaaagatggttctgtctttgcagagggagttgaaagaatcgcgaaaaacgtcgagactgcttccaataggatggtcctcaatcaatctggactggccttggtgcgccatggcactgtcataggcctgttatgtagcacgagatgcacaaagccgtgttgaagtaggtgtgacaaagtgacacccagcccccttcgggattatttcgaaacagcgttgtcaaccacattcctccctgcgtcctcgcaggggggaccaataggtacgcacctgggtgcgcacgtaagtgtcacgtgttgcgcacccggtgcgcgtggaacgacttctctctctaatgccgctgcttctcgcgctgcctcttgcgcctttacttgagcctccgcctccttctttagtcactcttgatatgcatcaatattcgaagagacaccatggcgaaaagcaggccagcatgcatccctcgcccactcacgcaagacctgtagtccatacacgagtttacatatcccctcgatagtatccgtagcacccaagaccagtttattccagcaaacagtcttcttgccctctcgcgtcgtgataacaagaaaccaattatgcccttggataatgatcccagatgcctacgccccctcggcaggccgccgtctgagagccaatgtctgaaggggcacaaacaagtcaaccgtgagtgcacaaagacgatacccccctcacccatatgaaagggggtcagcaggatgatgtatccctgccgctgttaccagcagtatgcaacgtaagatgagctgcctaggcaggcgccgtcagtcgtcagcctccggtcctttcagagagtggcgcgaggaggtctgtgacgacgacggctgaaagccagacggtcaagagcacacacccgttgtcctccggcggctcgagtacacgtagcacttcgcggatcgactggacacccctctatcccagccacaatgtactggaccccaagactgtcaccgacttgctggagtggcagcggtggggatgcgtttgcgcgttcctcggcttctcgacgtcgccgttgctcttcttcacgttgttgacgttcgtgctgggcatcacgttccgcggcttctcgtcgactcctttcctgcagtagttgggcccgcagttcttcagtatgtggcttcgtaagtggcttacattttactcgcttgtgacgaacattgacaccacgctcaatttgagccccgcacccctggcaacaccatcatccgatggtgtggagtctatgacatcgactgacataataatgccaccagatggccatatgttggtcagtcgtaatatcgccatccttgccaatgcccactgaccattgggccgcgcacacacctaattccaagtctgttggcaacagcacgatgccccccaaccaaacctgccacgatactacccctctatccggtgaagtcggcaatcgcgcgtaacgtggggtgttctagggtctgtgtacacattcgcagacgcacccgcgcgatacgctgtaacgcgctgttgccagtatcgaacggcggcgaattgcatgagaggtactgagatatactgatgcatgctcgtgctgcggctcacatcgatggcacatacccttccactgccctggtgaaccgtggaaattcacatgctcgcaagctaccactctcgcaccgtaccgctcccacacaagactgtgcggcgcattcggtcaattagtcctgccgatcgagcggggtcgcgtccgcttcgtgtccactgcaacaactgaccaaccagttcagtaggtgtggggacaagctcttgttccgcgccattattgggctactggctcgctggcctgcaggcgctacgacctccatgatcattggccaccgttcttgctccttccttcctccgacatacttcaatcaaccacagatatctctcatggcgagactgcagaacaagaaaaggtagcgcctagacgatgccttgttacaagatcattcgggaaacacaagactagtgaagaagagcaagacgagaagggaaatcgaatacgacaactgggtaaactggaaaccctgccggatttctacgacaagttgtccaagatccatcttattcacaaggcattggaagagttcgaccgacgtaccaagacacaacgccaccgacacttacgaccacgattctcgttcccggtcgacgagcatgtcagcggagcagttttatacgacgacaatcctccttgttattttcatgctctatgatgagaataatgattaagtcttcctccaacctccatgcgaagatctgccatatttctcatagtttgttgctcatatgtagtaattccgcgttgctttccattgtgtccctctgctggtttgaaatctataagcggttggcaaatagcaacaaggagaagcccgtctcgtatttgcatattatacttgaactccccgatggtactcgtggtatgatgaaaggtaatcccagagttgtcgagctggaccatgcataggcgcgatcgaagaagacgcttgcatcttttatacttttcagagtcgctagaaagctgctgcaacttatccaagactggtgaaagcgtgcatggtaatttggtgccttgtttaagtattgtatcaggtaatttgttagtctggtgaagcctggctatgctttgcggtgagggcctagcccgaagccgaatactcttgttgggtgttttttcgtccgatgggataaattggcgcagagtccacttgagtagtgtgatagtctctcttttctcctcaaggctctgagagtcctttgtatctgctaccagatataaagcaattgggataataagctcttgtagcccaagctccttgaatttctggcttgctgtttttgagaattggaatgataccacgggtgtttgagtagataaaagaaagaatctttgctagggttaaaaacaatgaataaagttcactggaattaagtgaatgcgttcgaattatgaaggatataagagagggttcgaggaggttggagagtcttttgcaggaccgcatggtcggaaagatgctttggatgtcaagcatcccgaggatagttactaaaacttcattgggcaagtcaaggaggctctgttgcgacattttcggaaaagccttgcggatagacgtgaatggcagactgttattataattgagggctggggtgaaatcagcttagggctgggaggaagagcaagccatttatagttgatggatgggtaggcataaccggacattagccatttcatagctgatggatgggtagatgtaaccagacattagccgagttgacccagctcatcacggctgtattctcaacgcatacgcacttccgccctggcactggcgtcggccagtggggcatgacaaccaacctgaagtggcaatcggactagccagaaggatggacggcaaccttgtggcgacgagtgcgtcagggaaggcaggccgcatcagcatcaggagcatcgttcatgacatacatggtgaccgctaagtgccggccaagatgctatgggtcccttccagagaaggctttcccatggagagagaaaggccaaggtcgaggcgcagagagcttggatcatttcgcaagaatcgggctgcctagatccagcccggagctcgccattgactacaataattgtgttggtgtcgccaccaacagcttccagattcacaggtaaaagggataaattgagactgttgcttctaactagtaattacagaggggatccggggccccttatatccctgggaatcccgtgatcgtattctcatgcgagcagcctggtcccgggctcgtaaggtcctccaggtatccctatccctagcaattgctagggatattcatatccggatgaccgaggtcatcttcttccttcaatccgtgcgatggataggatcagaacactcttcgaggtatcaggcccgcgccgatctctcggtattaggttgatcgtcagatcagtaggttcgcgatcaatcctaccggctagggttgcttgagccgataggtcagggttctgacgatcagttccaattaggttgtagccttccaacctagccaattgacccctctcggtgaaactgatccttctaggtctgttgtatcgtagcctcggctatcgtgtgattgaaccttacttttcccttcgaagccgggccggcttctacggaattcctgatgttagttactagcaaattgtatgtgcgttcgaacaggctgggctgcgggcttcaacgcatccccaccgctgccactccagcaagtcggtgacagtcttggggtccagtacattgtggctgggatagaggggtgtccagtcgatccgcgaagtgctacgtgtactcgagccgccggaggacaacgggtgtgtgctcttgaccgtctggctttcagccgtcgtcgtcacagacctcctcgcgccactctctgaaaggaccggaggctgacgactgacggcgcctgcctaggcagctcatcttacgttgcatactgctggtaacagcggcagggatacatcatcctgctgaccccctttcatatgggtgaggggggtatcgtctttgtgcactcacggttgacttgtttgtgccccttcagacattggctctcagacggcggcctgccgagggggcgtaggcatctgggatcattatccaagggcataattggtttcttgttatcacgacgcgagagggcaagaagactgtttgctggaataaactggtcttgggtgctacggatactatcgaggggatatgtaaactcgtgtatggactacaggtcttgcgtgagtgggcgagggatgcatgctggcctgcttttcgccatggtgtctcttcgaatattgatgcatatcaagagtgactaaagaaggaggcggaggctcaagtaaaggcgcaagaggcagcgcgagaagcagcggcattagagagagaagtcgttcgaccgtgataatggtggagcgatgatgcattatgacaagtgtcgatgtttttggttcccagcgttttaagaattagttgttaagttaaaggatagcgtgttttgatctgtacaaagggtgtataaatgaatgaatgaagtatattacgcccgggagggttcaactcatagggccaagtgcgttgagattgaacttgaatgtggagccctgggggtacctacggaggagattggcgagaaagtcttccgtaatggacgggatggaattcgcatggaaaacactgtcgatgctggagagctccgagttggagaaggcgagtacgtgacagggacgaacctcggggctgtggctcgtgtcgccgccgctgccggacgagctcgtgtagccccacttatgcgcctggtcgccggactgggggtccgggtgagcacgaaatgatagtctcgggcggtaaaagacgcatccttccacctcgattgattctctgatgatgttggcggctctcgagtagacattgacctggtcatcacgttcgggtgctggggccggttcggttgcaaagtacgagtcttttgggtccatgtctgacatgggggtttgggccgtggcgtctaccgcggacaggccggtttggggggcgggcaagaggccgagggattgctgtttggcgttgatggcgccttcgaggttatcttggttggcgtaggcggcggagttggggctgaaccgccaccctgataaggttgtttcgccctcgacaaaaggaacccagacctcggttcatcctctcgttcggtctatgtacagacttgagaagctgcgactttaggtggttcatgatgtttcgagaagcatgttgaagatgagccgtgtacgtgtcgttccagggccggcccggagtctcgtcaaccacacagtagacgccaatattgatgcccctccgtgtgcgaacaggcacggcggcgtagaacctggcctcccctccaaagttatgataagacttgtcgctgaaccggggatccgtggctaggttgtcgcaaagggtgagggggaggctcgtacggtccgagttcttggagatgacggtgcactcgcatactccgaaagagcgaggtatggccgttccgaagagccacaaaggcgccggacagtccttgcttgggagcgatggctgcagcggcagagacagcatggcctcggcgacaatgtgctggcgctgggcaccaaacagtgacaggaaggccctgctcgtgcccgtctgccaggctcccagttggcacagagctgtgaggatggcatcgttggaagtggacaactcgacgctcgggatgggctcggtcgggttgttgttgaacctggaggcgcccaacagcttcgagccgtatctgtttcacggcacaagtaagcatcaccgccggaacctcagggaggatagggaacataccttgtcacttcgtcttgccgcgaagcctcggatgcgttccagggtggccttgtccctcgctgcgcgatgggatcgcgggccaggagttgtggccgtgggtgcggactccaacaaggtcgagaaatcagtcttgcagatatggatgcgagtgcgggactggaatgctgccggccctccaattatctcccccgcacctgcatctccttgatgtagccagtcgggtagcttctgcgccaagtttagcccgccgggacgttgcacaaggtacaggaaacaagggaacgaggcaatcgggtgcgtagcaaatatccgtagtaccggatggcagatggcctgtcattgttgatccatcatctacgcatctcgccggtgtggctaccgtctaactctaggcaattcgatgcggagacattggccagatccagggcgcatctcaacggtggcgaggatggagtgcacatcgcgaatgctctggatttcgaggggcaccaacaagtggggacctaggaggtaatgctccgctgcaagtcgagacgccatgagactgcataaagtatccaatcagacgatagaaccggctcagggtacatccctaccgccttgcctgaggcatcgcaacatgtcgagattgcatagattgtgaaaaagaactttgttcggccgcgccgtgccgtgacaatgactattttgcctcaactgctatcctactgcagagctaactcccgctcaaagacattaatgtggttttttaaactgcgctacacgcacgatttcgtcagctccaactgccgcctggcatccttgtgtaaccgagccccgagaagccccagggtctgaaccgcgtctccaccactcacatcgccgtaaacactcgcgaaacgaccatcgccgcccccttgccaaaatatcggtgcctggcccatgtccagccccgccagcgcccaatcatagccgccagacggcgcactcgtgctcgaatccacttctgcccgccgcttcagccctctcctccttcctccacttggggcaggaggctcggccaaggcatggctcttgggatgccgcaacttgatgcccatgtcgctgttgagctcaaacatgatttccaggtcctcgtctccgcgcgaaaactcgtagcatgcctgcctcgcttgtgtttctgcagcatctgaggatggccgaggtgaccgctgctccgcactacagggaggggccatgatcggcgaggctggtgccgcctcggatccagccgtgagtgggagagatataccactagtccgtgcttcttcacttgtccgaggtgggaaccagggtccttgatctgttgcttcccagtgcatggcctgcagatgggggcgttctcctacgacgggcaggtaggtcgctggtgcgctgcgtcttgcaaattggcacgctgacaatgaagatggagcgacgcaatggctttcggtgaagggatagaagtggtcgacggctgcggccagcgcacggcttggcattgacgcgaagaagacgtgaataaatactagacacacaaggtaaggtaggatagaatctgatgaatagagcagtgtcttgtcgtgaagagagtaaatcttgaaccgcaatgatggtgggcaatctgtcttttctggcacaagctaccaaggttttatataggtcatatagatgaacaagctacgcaattcttgctcgagaaaagaggaattttgaagaatcccatctttgtgacgcacaaagctgtgacgactgacgagcactgatgtcacatgctgtcataaaagtccttatcggacccgaaaatgatggcaattagactccgcggcatgcccctttttcgcgactaggcctgatcaatatcaagtatgggaaatggcagggtagaggctgcaggacggccgttgctttgcaattggagtgaggaggagagctgtggtctggttggttggctggcctgggcggcattcctgaagcctgttcagtggcaagtcaaggaagaaagaggggtgcagatcggtcagcttgttgccaattcgggcaaagatgtcctaatattggacgaccctgaagacaaagctcccgtcccttcattgacggcgttcgtctggtttgtgtgtgcctatccccttatctcttaggttgatgaatccccgactctcgtagcaccagcagcagttacggcggccctggttcggcgtaagcccgagtctagatgcgggcgctgatggacatgtacaaccctgcctagggaggacgctagcagccaatgtcgtcatcacccttgataattatgctttgcaatttgatcaacactatccagctccgattacctggggttgacccccctacctccggtgacttacttctcccccccttgtttggaattggtatactccttcgagatattgccgaggtaggttagcgacataggaaatggaaataaaatctataatgaattgctgataccttactggcgaagaagcgaggtggtgatattgaaaccggctggttatattgcacccttaaatcaccctggtgaaccgtggaaaatcacatgctcgcaagctaccaaggctgtgcgacgcattcggtcatagtcctgccgatcgaggttgcgtcagcttcgtgtccgctgcaactgaccaaccagttcagtaggtgtagggacaagctcttgttccgcgccattattaggctactgcaggcgctacgacctccatgatcattggccaccgttcttgctccttccttcctctgacatacttcaatcaaccacagatgtctctcatggcgagactgcagaacaagaaaaggcagcgcccagacgatgccttattacaagatcattcggaaaacacaagaccggtgaagaagagcaagacgagaagtgaaatcgaatacgacaactaggtagactggaaaccccctccactctaagagaacttcatcaccagtacacgacctgaatggcagccgatagcgaccgttgatcccaccacagccgatttcatcactcgatactggggaggtagccaaagcatcccctttccatcttttgtaatccatacactgtcggtgcttataccccagccagagtggcgaacactctgtaaagttgcgtcagtcgacccattatcgatggcaggcggtagaaccgggagatccagattcagaagtccaatatcggtagagagaagagagtttgtactcggatcgaataaaagataggtaatcacccggccaaccctgagcgtctgcacgcacgcacccgttgccacatcccagatcttaactgtcttatcgttcgagcccgacgcaacctgctggccatccgctgagaaggctaccgagtttaccgaatcgttatggccctcaagcgtctgcacgcacgcacccgttgccgcatcccagatcttgaccgtctcatcgctagagcccgatgcgagccgctggccatccgctgagaagactaccgagtttaccgaagcgccatggccctcgagcgtctgcaggcatgcattccaatctgattccacgctcggcatcagcgtaatccagttcggctcttctttttcgaagagctctctgactaggctgcgggtgggactaaacacgagtgctaatgcatagacctgtaatggagcaatctccatggcccgcttgtgagaaagaataaagcggcgcgcgtcgcgaagtagttccattaattgtcgcgcttccttggctttctgccaacatgtcagaccgtccagcttatacgtacctttataacaactcacgactactaaagcttcgagcttccgcactgctgtgaccccctccgacatactgcgtaacagactgagagattctaaccaatacagatacttctttcgaaggaagtcatggacagtcaccgcgtcctgtaggttcttgtccctcatcctcaccaggggttccgagtcatcgagatggtctacccagaagacgcaagaatatcgtatcgaagccaatgggccaggattgggcggcgagacctggtcgatgggaagtcctggaacgtccagttcgtaaacatcacgttcgagagtctctgagagagcctccagtgacctcgcgaagatagcatggtgctggtgtgcggcgccagagggtaggatttggtcggatgccttgttcagtaggaaatccttggctgattgatgcacaaagtagatgacaccttctcgaagagtcaggaaagaaccgcaggatctgatgatttcttccaagtcgtcctggtcgaggtcctcgagcgactcaacaagaaccttcaactcgtccaaggttataggtcggtatacgaccgaagcgatggccaggacttccttacaaagatccgcatccttcgaatcaccgatatgccctatcattcggtcatagagcgaatcaagccccggagggaatgacttcaacgtgttgagtgtatgccgttttcggaccttgggatctgcgagctcttgacagaccaaggccacccagagaaacgtgccgtcggcattggaggttaagtaattctcgacagagtcccttgtttccttgtcgtattttttatggcatgccaatcgatccaccttgtatccaatgtacgtatcaacagccttcgagattgagtccttgttcaactcgagggacaacctaaccttctgcttcgcactgtcaagtttatcctcaatttctggccagttgcgactggatatgatccacttgacgcgggatgaagatgtcgatgattgaatgatgaaatcaataagctggggtcgatcggtaatgcactcgtcaagggcgtcaacgaccaagactacatctttcaaagtcgggtccttcagcatatccgtgagtatctcaaccagagacacccagacattaatgccctagaagagtttctcgcctgtaacatcgtgcttggaccggaggtacgagataagcgatggttgctggatgatgaggatgtagatgaggctacgcagcacagacgccgcattgcttagttgagtctcagtggcctggcagaagaaataagaaagaagacaattggatccctcctctagctcgtcgatgatgccgcacaggagcatggtcttgcctttgccagggtcacccttaatccagagcagccggttctgcggatcgtcgcgaaattgctggaatttggcgtggtcaagaatccagcgataagagtccctgagtaggctacccttcgtgtcttggattcgcttcttatcctcgcgtggatcagtcacgtgcagatcctgcatacatttctcgtacttggcgtcttggtatctcttctcttgctgtcgtgtttgatccttaatggccgaatggatgccttgcagattcatctccagagcgcttgcggtgtcggtgagtttccggagatagatcttgctctgttccgtgttgtattgatccgagtctgttcgaacagcagcctcggctttctggatgtcgtcgagctggccagcccagtcatctagtcggagcacgtccctcaagaccacggcagcccagttgcggtggtaaaggcagacgctcttcgtctgatacgagagaagtttctcgtatagctgcacgacgtgcttctctagttggactcgcagtcccgcggaagactgctctgccttattctcgtcgagaagtagggacaccaagttccagtaccactccattctcgccaggacgtaggctatgccattgcgattgtagcgtgcttcggtgacggggttcgaaaggatctagcaacggttagagggggatcatccaccgttctcttcggttaggaaagctgatcacacacacctctagtccaaggcagacgccaacccaggcgatggcggcttccggtgcggtctgtatcgccttgtccactatccccctcaccgcttgcactgcttgcaagccttcgtcgattcctcgcttgatggacgctgctttctgcgtccggtctagtccatcccggaccaactgctgcatttggcggcgtcttgtctcatgagccccttctatctcgttttccgttgattcgcaagtaacatagctcgggtcatttcggtgaagtccaactgataggatcttctcgtacgcttcgaccagtttgggctcgctcgctttgagctcgtcgtaggcctggttccaaagtcgctcttgtagactcggtagaggcgaggtttcggcatctgtcgcggtggttggagaaggcgttggctgaggtgttggtcgagctgctggttcagatgcaggctgagacggtgtcggcgaaggtgatggcgaaggagccgaaggagacaacagctttttggccttgaattcgactttctcaaaccagcgaggcgccatcttcactttaaagaaggcaccttggccttgttgcgcgatatgacggtatcagcgagatgattatcttctgctttactccaatccaggtatgccatcatctcttccttactccaatctctagatccggtcggtgtcgtacagagtttgcccatctgcttccagtcaagacaccactggtagcttgctttgtcataccgcaaaggtagacctaacgccctccgatactgctggttagttttgacgctaccacgaggctgcgccttataccaagcatctcgagcagcaacatatctccgatagatagcttgtgggtcatcatatcttagtgtcggcgccactgatgctgttgaagatgatgctgctgtctctatactaacgacaatgcagctagtatcatccctgccagacccagcatgtccggataatcctgatgacgggtcttccagtggttccccttcctgcaaagatgatacagatgcagatactgctgctgctggtcgtgcttccccggataatgctggcgagagtgccactggcattgcttctatctgtgctgatgatgatgacaaatacaaaatcccctcgtaccgttgaggacatgcctttgacgtcatcttgtgtcctaatttgtggcatctactgcatgtaggtcgtgcttttggctgcgctgctgcctgaactgcctcgaatgcacttggctctctctgggtgctcgattgcgatttacttgtggtagaatcggcagctattcgatcagatcggtgtcgaggctccaatagcacctgatgaacaccatgacgactcaaatgccaatgcgggtgaaaatgctccaagcgaaggatttggccttgctcttgtagagccttgagaatatgggcgcaagggaggccgtgggatcgagagaatgtaccggtacaactaggcaggtcttctttcataagccgcttccgctgttcttcaactttgcgtaaagcctcgtgagatatccagccacgtatggcactatatagtgatccagagagctcaattggtattcgcatttgctgcctgacttggttggatcgcagctcagataattgattaagaagcgcatgtttcatagctctccacgcctcgaagagatctagcgtagatttcttgaggtggctcttaaggagcccatggataccctcaacccgtgaggtgaccacattaccaaagtgagggtgctgatcgacccaggccttaacgagctttttcttgtacggatcgagccagttggacttgatgtagccaacctcttcgagatattgaggcagatagcgcttttcaagctcttgtacgcgctggtcaaatgcctgttcatctgacgacctcataatcgaatgccagtggttgaaaaagtcattccagtcgctcagaccttgctgataggcctcagacccttgcttatggtgtacgaatgttggctggcaatagcggaggaccgcctttttcgcatgccataggcatagcagagagatcgaagacggaaagcagctctctacagcgttcatacaggccttatcacggtcagtcagaataacagatggaaaccttgtgttgcagagttcatacagggacctgagccggtccaaggcccatatgaagtcctgctcagcctcgccattaaggaatgcgaaggcgatacagaaggatcgctgacaggcatcaacaccaatcatatcaagcagcggcattccgtatttgttcgttttgtatgtgcagtccaagaatagtagatctgggtaagccttcaagtatgccaatgactccggatgggcgaacaacaccgccgtgattcggttatctgagtcaagctgcatccggttccagaacccttccttgtctagctggttagcaaaagcatgtatagtgctctgaccctcacagagctctcgtttgctatctgcgatacggttgtagatatcttgctgggttgcaatggtattcgagttctggcgaatataagtcctgatatcttttggcgctacaccagcgttcgtaaggcggctgattgttgacctgtccacatccgagagctgccgatggactgggtgcgccgatttgtgccaacttggttcatggttgtgtgaagaaaattgtggatccggacgatgccttaaagaccaagtcgtcttatctagggattccttcgcgatgatagagaaccggcagttggttcctcgcgtagtagtcttgcgctggcggtctcttgaggcgcttggtggccgacaccatcgatcacatgcgtatgtgataatctgcctgccgctggttgatcgcgacgatctcccagttatgaacgcgtatcctcttagtgctgcccattcattgatagctgtgagtagagcctctcgcgagtcgtacgtgccctctggcggaagcacatcatcaggaaatgccgtctgcgccataacggcaacccctgaaaactacggttgtggttagcaatggcagcaatagccgcagcccctgagaaatgcagtggagttgtgccaaattgggggctgacataatccgcacgcctacgcgtgcagaagtggagcggcgcctaggcgtgtccctatggggcccctatgctagatggcgactgatacatgggcacccaggtgcccaaattatgtcagcaccatccaccggcccaccattcgccatcgacgcgttcgcatcgcctttgcggcaacattaacttcacgaatgatgggccatacggtattccctgacgacattctcccccctgagggtacgtatgagtcccgtgaatctttattagcagtcatcaattcttgggcaaaacctcgaggctatgcatttacgaccaggaaatctctaaagactcccaatggccgtgtccgagttatatttgcatgtgaccgaaataagctgccaccaagcacatctatcgatcgagtgcgccgcacctcgagtcgacgaactggctgcaagttctcggtcctggccaagcagtctttagatcgaaattcttgggtgttaacccacaggccagacaaagactgcgctgggcacaatcatccaccaagtgaggacccgtctgcgcacccggcgcaccgccgactagaggagcaagatgcgacgatcatatctaaacttatgacgtctggtattgctcctcgagatatacagacctacgctcataagcatttggacaccctgattactcagcgggatctctataaccgttttgcaacgacaaggagagatctccgggaaggccagagcagtattcacgccttggttgaccagttgcacagcgagggtttctggtgtcgagtccgattggatgcggacaatcggctaacagccattttcttcgcgcacccagactctatagcgtacctacaatgcaatccggatgtcctattattagattgtacctataagacaaacaagtaccatatgccgcttcttgatatggtcggagtcgactcttacctttagaacctgtgagtaattctctggcgctacttcccatgcgtgataccctaccccataatgaatcactagttattgaatttagcttactttaaacctttcagagtagccaaagagctcaaacctactaaggaagaaagtagcagagtatagtagaattaaaacctttactatttgtaaatatataaaagttatgatcaagataatgggtcatacccaagctattatacacattactttagtaataggtagttagttagaggagtcaaacataggtgccatataattctacataccatcttcgaggaggatttcacaagtcacccggactttcacgtatgcacgtatagcaaagaatattgtcataagtatatcgcatccaataagcacggcaaggcctaacgtgcgaccagcatcttgtggattgccgagatccggtatatcaccaggcggagggggtacagcacctggatagcttgcctcggctttcatgctttcagacgtctcagcaaacatttagaccgcagaagatgaggatctattgccacggacggttgctggcaacactagtaatatagcccttctttctgcagaagccgtgctgtataagtagggtcccatgatctgccccaaaatatacagtagtgtctgtttgaggaataacaggtaatagagttttactcacccttcgagatatcatcatccacgactcatggctatttaagctcctggaaaacggataaattcaaaccgcatatacatggtccagggctaagattgtggtcatttagggagtatagtacataccttcgacacatggtgctgcacaaggttttgcctataaaactaaactaattaagggctactgtctcaaaatcttataaagagttggtctgcgataagttggaggggagggtgctgaaacgctccacgtcaggtctagttaacgtaatccacaggtgagtcggccacacaagtgagtcggccacttttacctatccctcgtataataattacctttagaacctgtgagtaattctctggcgctacttcccatgcgtgataccctaccccataatgaatcactagttattgaatttagcttactttaaacctttcagagtagccaaagagctcaaacctactaaggaagaaagtagcagagtatagtagaattaaaacctttactatttgtaaatatataaaagttatgatcaagataatgggtcatacccaagctattatacacattactttagtaataggtagttagttagaggagtcaaacataggtgccatataattctacataccatcttcgaggaggatttcacaagtcacccggactttcacgtatgcacgtatagcaaagaatattgtcataagtatatcgcatccaataagcacggcaaggcctaacgtgcgaccagcatcttgtggattgccgagatctggtatatcaccaggcggagggggtacagcacctgggtagcttgcctcgtctttcatgctttcagacgtctcagcaaacatttagaccgcagaagatgaggatctactgccacggacggttgctggcaacactagtaatatagcccttctttctgcagaagccgtgctatataagtagggtcccatgatctgctcacaatatatacagtagtgtctgtttcaggaatcgcaggtaatagagttttactcaccattcgagatatcatcatccacgactcatagctatttaagctcctggaaaatggataaattcaaaccgcatatacatggtccagggctaagattgtggtcatttagggagtatagtacaaaccttcgacacatggtgttgcacaaggttttgcctataaaactaaactaattaagggctactgtctcaaaatcttataaagagttggtctgcgataagtgctgaagcgctccacgtcaggtctagttaccctgtttaaagttttatggcacccaccacgatgtgatgatgcaaccactgtcctgagcttggcggaagaagttaggctctctatcatctccgattctccgcttctccgactctcatcaggcgtagactcggtattttagctacactaaacatggcaagttctcagcgataacccaatcagagctggcttcttatgcctcatctagatacctctgtttatacttgctactcgaaataatttcttcctgcctattctaggggtaacgtttaacacatctattttgctacatcgctggcttggtcggttagttgccattgaggctctaggccatactattgcacaccttgcaagctaccgattcaccagagaatcattcttaatgatggtttcgccttcaaaaccacttctattctggggtttcgttgtccgtagctactatctgatgactcaagctttctacgtactaatctgctatgtccaggcatctttgtcctttattcttctttgttgccaagcctcaagccctcttcggcatgctttctatgaaacctttaagcttcttcacatctcctttgcggttgtttcaatctacgcaatctggacccacttaagacttggagacctcccgcagcttaagtatctatacgctgttgtagcggtttggggagcagatcacctcttacgtgctgttaggctgatatggtcaggaataggtcagtcaagtttgggcacatcgattgaggctctttccgggaacgtctgccgggtaacaataaacttttcatctgcctgtcatatccaacccggacagtatatgtacttatatataccttcagttagcttctggcaatctcacccattctccgtagcgtgggttaataaagcctctgctccaactcctagcatggaacagtgtaccgtacagcgacagcaactgtcattcatcgttagagcaaaggcaggcatgacagactctctatatcagcgggctgtgtccgctcctcgtggcaggttaacaactccatgtttcttggagggtccatatggactgagcccctctctggtatcctacgggactgtaattcttattgctgggggcgtcggtatcacacatcagcttttgtatgtcaaaagcctgcttactggatatagtgagtgtactatagctactcgcagaatagtactcatatggtctacaaaacatctcgaccatcttgaatggataaaaccatggacagacgaaatttcggcaatgaggggatcaatgcaagttcttgaagccaagatgtatatttcccgcccgcttggctgtggtgatgtatatgtctcaagctcaattttcgaaattatccgaggtcgcccaaatctagacatgctgatagcagcagaacaagaacaccaaactggagctatggttgtctccgtgtgtggccctggagaattgggtgacgaagtacgctatatagttaggaagctccagaggtggagcactattgacctacttgaggagtcattttcctggtaacagagtgagtggtagacggaaataagtagatacatagtagaacgtatagcaagcaataaattttattacatgaagtagcttactaaacttatgctatatctatagagctgcgaattttgtcgatagatcatccacctttgcatccacggctgaaccattatggggatttggactaaaatcttctggctcagaagcatcagaatcattttcctcatcttcggtgtcctcgtccgtcatagtgttatcgccgcctctataggccacccagtcgggggttttgatttttacctccctttctctccttgtctttgagtctggcatctcccgtttccatttgctatcaagcccataacccgctgtgttgcagtcacacggcccatagagtggattctcatgtgatagcaagagactttgaaggcagcgagagtgtatggcatgtttcttgcaatatttccagttcatatcctcatatatttgaaatcttctactgcagacgttgcattgttgtgcagaggctggcagcgttcttagaaacgcatcagtggctacaacagggaataccgattttgcatcgtatttctttctgtatatctgaatatttgtaaggatgttctcaacagttatcgagtgttcatatttgaactgttgcatgaccttcatccgaaacgcctcaggcatgtcatttatagcaaatgcgatatagtgcctcccccggatctttctcagtttctcaaatgcatctttccaagacactgagtataacattgatatgtatatcctcatcctcttcttgttgctaattggatttggttcttcccatgggatttgcaacctcagatcttctggtcttatatgatccattttgcacaaggttgaatgtacagtatagtgaaagacctttcagtgggttttaagggatcgtggggtaccagaaatcaggctgacctaaaacaaggtcgagggcaagaatcagacaagcttacatattcttaggagcctaaaaccgggataactagctataaaggattcactacaatgtttgacaacatacatacatcccatgaggcaattaggaggcatgcatctatactatgtatgtttatcaatctatgcagtgaatttcttacagacacatggcagtttcagctcttttaaaagtattctcgaaggagctttaagaagaatatttaaaataaaatccaattaacctgccacgaggagcggacacagcccgctgatatagagagtctgtcatgcctgcctttgctctaacgatgaatgacagttgctgtcgctgtacggtacactgttccatgctaggagttggagcagaggctttattaacccacgctacggagaatgggtgagattgccagaagctaactgaaggtatatataagtacatatactgtccgggttggatatgacaggcagatgaaaagtttattgttacccggcagacgttcccggaaagagcctcaatcgatgtgcccaaacttgactgacctattcctgaccatatcagcctaacagcacgtaagaggtgatctgctccccaaaccgctacaacagcgtatagatacttaagctgcgggaggtctccaagtcttaagtgggtccagattgcgtagattgaaacaaccgcaaaggagatgtgaagaagcttaaaggtttcatagaaagcatgccgaagagggcttgaggcttggcaacaaagaagaataaaggacaaagatgcctggacatagcagattagtacgtagaaagcttgagtcatcagatagtagctacggacaacgaaaccccagaatagaagtggttttgaaggcgaaaccatcattaagaatgattctctggtgaatcggtagcttgcaaggtgtgcaatagtatggcctagagcctcaatggcaactaaccgaccaagccagcgatgtagcaaaatagatgtgttaaacgttacccctagaataggcaggaagaaattatttcgagtagcaagtataaacagaggtatctagatgaggcataagaagccagctctgattgggttatcgctgagaacttgccatgtttagtgtagctaaaataccgagtctacgcctgatgagagttgtgaagctcttatgagattcgtttgaatgcatctggattgtagtcagtgccacattaatccctagataaacgagcattacaagaagctggaggcgcgtgggaaaacacccggtcttcattctagaattcaactgcattccttgagcgtgtctcttttcaagtattggggcgtaaacaatatgacgtttcaaggccgaaaggcaaaaggatggctttgcgaaccacctctggtttgggtcatttatgctaataatagtgcgcaatgttcgtatacaatcatggctgactttccatattaggactataataattatagcaccacaggtagaaaggggcgtatatggtaaaatatcattaacctgtaccatctccttggaaaattccacatctgggaggtgaagaataaaagctcatgtacgcagtatatatagtatttatatatattaatgtctagttttttttcggaaatcccaagtccttaattagggaccagccttgtttttggctagaggcctggggttagtcagtctagactagagttttgttcgtaacgctagtatattttttttgcaatttactgtatgtaaattatttatcttgtagctatttacctgcgtatatattaagcacctgtatgattactttcggtatacccaggttataccgtgattctatgctcgcgggaaaatctccctttattgaatccgggtaatacgagcaggagaaggcgctgacaggattgcttcatgtattgtggactcgcgatactgattgcctctttgtattaactgagtgctaggaactactaatcggaatatctctataaaagacggtgactagccctcgaattaaacctatatgtataaaactctgttcttctgtgttcctggtgtgaaaatatctatgaggggcggccgccgtggctatcactaaggtaactaagatgttatatatgtataaatatatcttatgttttttatttccttaggagaatgatttctaccaactgtagaatgcgataacttatatacactatacatagttctaaatacatacagtatagttttatatataaatcaataaattctatataatatttgaaataagaagtgctatattttggcagtggccggcgccaggttcttgggacgatcctggaactaggacttgggtactacttaacttttcgactagagtctactatatgaatatatatatatatatgtacctatatacgaaggtgagtatatcactgtaataggattggatctgaggatattatagcttcttattctggctcgatggtggaagaagtcaaagaacgacagttgaacagcttggtaatttcttactgtgattttgttgagggggaactgggtaccggtatataatcttataaacaatgttcatgcttggggccaaaaacctggatcggatcctaagttatagcatacttaagtacccccttgcattgtataaatttgatgtcaagcccgcaatggtcgtgtcgtgttagagccccaaaccactctagtatgtgttggcttctgtactttacttttatcagccattgcttggcccattcctggaatgaacaacttagtgtgatcaataatggagcttacacaggacgaaatggctattgtcggggatatgttcctaggtcctcgcctggatttactgataacttgatggcctacttactgccaccattgtcctccgggcgtacaaggattgataatacagacgttttatgtccaccaacacagagaaacatgaaccagacagatgcttttccatggcttcaagttttgcctggatcatatattgctatcaaatatcttgagaacggacatgtatcatatcctcaaaacccacctggaaagccatcaggttctgggactgtatatgtgtttggcactacccagcctgatgcgaatgatattcttgctgatgtgcttatgtggacgcaagatggtacgggaggtaataagcgaggccggctactaactgctcaaaacttcgatgatggacggtgttaccagatcaacgatggggaaatctcgcgtaatcgccaacaagcctttcctaactttacaccggagaacattatacacgaacaatggtgtgagacagatatacagattcccggagatttataccccaaacagatctacactatatactgggtatggaaatggccaacgagtgcaggctcccctggtcttcccgaaggcaaggatgaatattatacttcgtgctcagaccttgagattgtatctgggcctcttccggatggacctgccaacccactacaaggccaagatcctcaaacgcatgccgtgacaggatttaaagaaaggtcctcaaaggtagtggctgctagctagataggaatacattgatatcatcacactttatacagcttcagttgagaaatgagcgagtagttaagcaagactagtaaaataggtgaatactagatgaataattagtccttcaacatgtgaatcattgtgtgtagcctagtcgcagaaagaagaagaattatacggactggaatctttcatatcctcttcaagcaatagcccataaggtatctccttcgggtacattggacaaacctggccgcggagatccttcaccaaattgcccgtatcatcccgaagctggttatctccgaaattatctcttataaatgtctctatcttatccgaactcgcgccaggtttttttttgaagtcctccacctgcttcatatatagccattgctgtttgaagatatctaaagtgatattataaattggtgaagaatatcgaagacttgaggttggtactatttcctctgccctcttgtatgtggatatcagtgcacccttgatgaagacctttagaacccactccagtctttcggtatcaataccgcctaggtcctctcgactctgtccaaacatacgatgtgtctgtacttgggccgtcgagggtttgaggattccaagacattgtagtatttcaggctccagtatgccaatagctgcacaagcgtcataggcaggatatttggcagttttcaaaaaagtctgaaaagaaagtgtacgggactaagactaaattttcttagcaaaagccataattatatcttccgtcacatacatatactcttcgcttgaatgcgatcgcacactgttaaagctcgtcgagcaagacccctaagcctctcacgaacgttggcatattcgtgatcttgaggcccaaatttaaccatattggaatgcgtgcgagcgatcgcgcagatatgctctgcaccattttcccaaggacggcaatgtatagctgaaattttggtaaccaataatgcaggcggtcctttcatctcccagcgaccattttttacctatcctagttagcaaccgccccttcaaagacagcatatcgcataccttttgtactgttggcgacttgagcgtttcatagaaactaaaaacctctgaacaatccttatcgccaaatacagtaggaaactctctttattgaatcgtgagtatctgagagttaatatgactaatagactcgaccagaaatcggtttggcccatccccaaccattgggatgagtgagctgatatccatgccattatatgggaccccaaagaagacaagcccataaacagccctaataaggttttgatcgtcttcattctttgacttcgatagggccactaaggcctatagtacatgttattagtatgcataaaagacctaaatatgtgggttatttcacctgcttcgcgatgaggccgcctaggctgtgggcaatgaggatgatgggtctcatcattggagcagtcgctagcgcatggagactgctgtgaaaagtggtggcaagatcctctatgttttggatgttctcgctctccgcgacacctgattcatatccataggtcatgacccgcgccataggctggccagtctcctcccaggtgatatcataggggagagaatcgcgcaaccacatatgatccccgcccctctctttgaacgatccaaaagcatggccgccaagacctgacaatgcaataacactgacctaattagtgtggaaattttcaattctctggcgatcaatctactcactcgatcttgtgagcatcaggtggcggcgtatagagtgtggtgataccgaggaaggccttgtcaagtattaagtattgtccgccggagagttggtcatctgaaggcttgggcaataatatccgctcgctctggcggctttccggggagagcgggagatcctggaaggtcactgtagccgtctgggagcggttgtggatgtcccgggcgagggacttgacaatcgggatggacctcttcctatctgctaggaaggaccccagttgttttagatcccagtcaacgggagcgccaacaacccggaatgtgtcgcaatctttcgttgtctccttgctcacaggtgtctcttttttcacatgcgcgtcctctggtatcaatcgtgcgcgtcctccatggagacagcgccatatcaataccgtgaagatcgcgatggtagccagaaggctgatttgaccagttgaatccatcattttaatggcgttaggagcgcgctctgggcccacacgagtgactggcgttcgtttagaggcagatgctagtataacgccctgccgctgttgaaaatggagaaaggttggcagatattgtacttatgtgtatagggcgaatactatatagtgacaagagttgatggaagcagaggtgaaatggcaggagagaggggaaggggggggataaggcgacccgctgcctcttggattgcggctgaaataccagatgaaacaagtatgcgaaccatacaaaaaagataatagccatcacccgcgatcttgagtctaagccgcgaagtagggcgagtgagatccatatagaagaaatcaaagcaaccgatgctattttcttatatggcatctgtcctagcatttcatcatgaaggatggtcttgatagcaaggcttgatcgggtattaggcagagactggttcgcgaaccttatggaaagctaagaggtacaaagactgacaccctatcgcattcgggttatctataatccggtttttggtcgctgaccagatgatgtaatcaattagctagcctggccccctgaggtcggatgtacataatcactcgccaaaggtatcgaaatttcacgctaacactgtagacacaattgttcccacctcagtacttagtctacttcgagagacttccttgctggccagtaacggacatttcccatactgtaaaatagtggaacatgtatactaaggtatttttaggtactctctcttctcaaaaataaatacaaagacaacagagcggaagctggttatgctccaaactgtaggacttgtcctatactatcattgaatactatttgacctcgattcgttacagctagcccatgatgggacagcccatccaatgatgcagtgagttgtggctatcccagcactaatcggtgtctgctatagctcccgtgtgtagctaggcaatatgagccatttgtagccctttaatgtgtccactccctacactccctacacggagccacggagccatttatagccctttggtgtatcctcgcccccagctctctccgtaagaagcaactgagaaatgcatggttatagatgtttgcaagattggtgtccccttttgtgcactgaagacattctttactagcactggtacttagtatcatcgctaataggcagcagcagcgaagtatttaagtgggcctgtgagtcagcctactctaatatgccttgccatgcccagcagacactgtgccatcgtagtgacagtacttttttcacgtgatgcagtctttagtgtatctccttgaagcagcgtaagctacactttgtaccttacaggggtctgattggtcagaaatcctagtgataacaggtacttcaatttgcatactaatttagcctatgatagaagttccaacaaacaggatcgttacaaagaggaacattgcaattctcacagccagaccgtgactgccgcacccgcttattcgggctggcctcacctaacggctttacacttggctcgtgataatggacacctctgcaggccgcacagcggcccgggctctttcgagagacgcgtttatgctgtgaaacaggcgtatttgtgtcgcctgttttgttcttctttcgtaggctccctttttggccgtattctcgtaggagatcgcgagaaatctgctcgcgccactcgtgtaaggtccgtaacggcttccaatttggctggccatgcttctgcagtaagaagctgttgcaaagaggtacgtatggcggttctcttcgttgtgcttgatgctgaacgagcggtagggggccttgggggagcgcgagctgaaggcggggcggccggtgcctgagctggcggagcgggatgatcctgaacagaagcggcggccgggagcagcagaggggtccgaggcccagaggcagaaccagccctcaatgccgagggaggcgattatgttgggataaatggtggcagagagccattggagctatgggacgagggcggactcgtgttagcagggctgtctgtgctcggcgaggataccttgatgtggattggtaattgaacctatctcgaggaatttaccgccatgcgcactccgaggcggaaacaagagactaaacaacggacgagagaatggctagagacattgccggatttcaataattatctcggatcgtaaaattgcgacacacttacttatttccttggccaagcggtcaactttgttagtgttagcaagtagaatttgtcgacaggaacatctatctgtttgctttggtctgtttccagctttgatatgtttccggaccaatcaaacgtggcctgcaccttgccagaagcttggaactcagctctgtcattggacaacttaggctacttttagaggacgtggctaacataagcctctgatgcactagacctattaaggcagttatacagctgggccgggtctgttttcgtactccaagagtccacacttaattgtatccctccagggcagagactacatattagatacattcccctccactcatcccattacctcgatcataccacttcttcccatcgtagtaattcctcgagataggttcaattaccaatccacatcaaggtatcctcgccgagcacagacagccctgctaacacgagtccgccctcgtcccatagctccaatggctctctgccaccatttatcccaacataatcgcctccctcggcattgagggctggttctgcctctgggcctcggacccctctgctgctcccggccgccgcttctgttcaggatcatcccgctccgccagctcaggcaccggccgccccgccttcagctcgcgctcccccaaggccccctaccgctcgttcagcatcaagcacaacgaagagaaccgccatacgtacctcaccctcctcgcaaccgacggtcggctcacagtcttcgagaattagcagcccgagcacctgtccgaataccagggctgccgtcagatcaatcaaatcagattaggacccaaatctgatctgaactgatagttgaccactcgaatctgatctgatctgattgattgattgatatctgatatatagtatctcatgtgaagctccccctcggcctcgcgatcctaccctcgagttctaactagccttattactcgagcataggcctccaagagtaacacaccctcccctgacccagttcttcagtagctggctcgggaggagaccctattcaactccctccctacctcccctgcctgggtggcatccaggcaagagaaaagttcgagtaattcacagttttgaaattctaggatgacaccaggggtgtagacttgaacgtatgggttatgtaacgtaggaatgctcgggttcgagactgataggcaatttccgagaccatgggattatcgctcccttctcaaatagatacattgcgacttattttgaactataacagccatgtgtgggctcggattctgtttttagatacataataacgacggtcaattatatcaagtgtatagttgaagacacacaattctctaaattaaccacaatattatcaaggaaacaagctatctttgaaggagagcagagatgcgttccattactacaactgggaaacttactatctaactatacacgcctcggtcaagttcacgtattaaattccagattggtaacagccaaaactaccacgtcttctcccacaccctgcgccaaaatggcatctcagccagacgagccttctcagtcttctgtctcatcgtgattccattcgcctacttttggcatgaggagtacgacgagatcgagttcgaggaggaaggccgaacatggaccagccgtctcttttcggcagccaagtacatactaatttttgtagcactagtcgttgtgttgttccttcttggtttctttgtgccgcctgcgggtaacaactcccaggcgcactgggacctcgattatttcaagaagctcatttcccaacagcatggcgagaaggccctgacctttgttttgggtctcttaatcatcgttggtactattctatacgccgtttacacaagtgccggcctcgttttgctcccagtctcctagatcaggtctgctccggcaatttctgctccacagctttcagccacaaccgcctcccaactggagatgaacggtgaacgacgacgccagatcgagatgcgcaatgccggacgccacgacgagatgcctcgcaaggatcgccgcgagctggacgctcttgtgcgcgaggaacaaacgctggtacgaagggagcgccttgccgctgaagcccaaggtgaaggccgcagcatcttgtaccgcttctggttcaagctatgtgctctcttccgacctgtcaagatgcttggtggcctcctgctcctggttcttgcggttctcatctgggcatctatgctcatcactggaattgacaaggcgaagaactccatttgcaagcagcgatgcggatacatcctaggccagacccatattttccagcctttgaactggatcttcctccaatccgccaaggttttccctgttgattacattctcatggcgcttctaattctgtttctatttggaagctctattacgggcgtggctactgttggaattcgtttcctctgggtcaggatctgccaaattcgacgaggcaggactgctccccaagcacttcttatggctactgtcatgctcacgctgcttgtgctggccatcaactatgctgttgcaatgctcgttgtaccacagtatgccacttatggaactcagaccttctgctcgaacaagctagcgatgcccggacttcaacctaactgcaccggccatgaagacatgatcataccttgttcagaagctctaaaagacagtcatgctaaagacgtgtgcaccccgtccatgatgtctacattcctcaatcgcattactatcacctggcccttcttcggaatggtcgacttctggacacaatttgctttcctcctcttgttcctgattgtgctcgtcactgccgtcattcgtaccaccaaggtgaatatgtctgaaattgacgaggatgccgaggcggatgaggaagagagtcttttggcaacaacgagaagacgatttagtgcaacatgggaggacttgaggggtaaaatggcgacaaaacccagccagggtggcactgaaggaggctcgtcatcgaatcctgtctgaaagccctagctgttgtgaaatgagtcgctcgatcgtagggtagtaagatttattgaatgaaattgtgttcttggaatatgttggtattatcatggatcatgtggggttggagttttggggagtccgatttcttacttgctaggttggtttgatatgttatgacctgccgttcaatttcgagatatggctacgatgaaaagggcaagggtagggatgctacatgctttgttggttgattgagaataattgtcacgctcctattgctacacgtttctccttctttccgtccctcgcaaagtaaactgcattgtggtccctatcatcaaatgccgctgccggcccgatgtgcatcttacgccagcaccgcacacaatagggttcgccgtcgtcgcatcccaggcatttcaacgtagcatcttcgagacacactgtgcaccaggagctcatatggccatctgtgtagttggtccgggatgtaagttgtttgggttccttggcagacttggaggaaggtacggatgggatgctgagagacggggaagctgaagatccgcgtagggcggaaagacgggcagtgatatcatccggggtattggaagagggtgacgctggggtattggaactggtgagatcttgggggacagagggcaggtcaaggtttgcagcaggcgcagaggtctgtcggctgtcctcctttgatgattcccgtggctcttgggttttgttggtgtcttcccggtcgtccccattggaggcggcgatggctggttcgacttcaatttcgtcacggaagcgggcgatgacatggtccacctcctttgtcgtttttttcccgtcctagtcatcatccgactctccccgatcatcatcatacgtctttttcgactccgaggattcgtcctgcggaatcgactgtgatagtgtgatagctcttccaggagggccttgaccttggcgtcatctagctccgccgggggttgtacgattggctcatcaggatcaacatggccaagtagctcttctaaggtgcgattatctgtcataaaagcggcccctacgtcatcgtcggcttgagggggatctcccttctccaatacttctttatgttgcttggtggactttgtaggggtagagtggtcccgcgtgtgtatttgtgaggatggcggaggagatggtgatggcgatgtttgatcccgtcaagctttgagacgggaggccaaggcatcttcccttgatggcggggtgctctttctttccatcaaatcaacatcgactctttgttctgttgggcagggtgtatcagccaggtcatggcatgtactgacttgactggtggttctgtctttgtagatggactggagccacggagagcggcgagacggtctagaagcgccttgtctttattactatccggtggaaattactcaggcggttagggtgagtgtattatgtgtgcaggggtgacagatggtcttctgggtatttggtaacattcgacctcaatcaagtaggttgagaggtgagggtccatgagattgatgagacgagagtattcaagttttaggtggcggtagtgcttgaaggttggaggtttgaagcggggtcttttatctaccagcgagtgaatcgaattaatcaaagctgcaagtcacgtaggccaagcctactgggaccctttgattgatttccttgaaaatatggcatgcagggagttgtggcggtcctgggacctgtggctgtcctgggaccacaaaggatgtccttgggaccacagtgacatatatgtggcccaaaggaacgaagtgatatttatgatttgtatgtggtagttacaggcgagagccgtttctggccaggccaagtttaatcttagagcaaaaatgggtatcgtggtttagaaactgacaaatcaagaccgaaacaaaacaaagctaacattaaatcttctttttcttaattagagttctctttaaccgtaaaatgattgcaaaagagccccaaagagcctctcaggcgggtctaagttagtgttttggcactatgttcttagacgtatctatagtattggaatgagcttaataaactgttttccgtaacgcgttccgtttcaggcatatattttttgcctctccgatttgagctatactgggtcggattagactcgttggtagaaggttgcttttccggagagcgcaactgctttagagattgcagcaaaggagtaattaggtatggttcaaaagcagcgccatcttctaacagtatgtagaattagaacaactgcagtgtggtagtcttcgtctaccactgaatgaagcccgatctacctctagacgcagcagaattggaccaatgcgggccaaaatcaggtttgtcacacaatacgaagttgatctcgtggccaaaaattgtatcctagagaaaattgtaagattttacctaagtacggtatacagtatataaattttaattatcatatacgtataattcatgaaggaatgaaaaaaatatacatgaaaacctatgaccaattacatagtatgcaactctatgaaggtgatatttattgagggggggtcagggctgttttggtagtaactaggcacatcgacaatgattttcaatttcttggaatccctcaactcgattaataggattgttcttctcaaaagtcttattgttgtggctggtttagttgctctgtggccgcctttcccggcgaataacctacttccatcagggcatgggagcatgtggcctagcctatagtgacaacgaccctgtcgtcgccctctctgcccacgacttcggtgatgatgctgcccccaacacggttgtctgtggcaagtgaatcaagatcactcatgctaatggcaagtccacgcgcgcctgggacaagttccctggtggccagtgcgtcagcggttccatccacgcctatcccggtgttttccgttttccagcagactaccgaagtcgccgttggccgtatcaaggttgtatgtgagtgtgtatggctctagtagtggcaaaagcactgactccattcctctcaattccgttaacaacacagccagtgtggccactgttcagccaccaacagcgccgctaaacaatagctgtcaggccaccaaagtgtgtgttctgctgatagtctgatgctcttaatcttcctctgagagagctctaactagctagctcttatggctagctagatctctcggatcggactaactaacaaccgaacgcccctaaccttacggcgtggtcaataacactctatatggccctacaatagcagtccgttagcagcaagattctattcgacttctatagttgtatgagataaaaggattttgatattacgtcggcggaggctttagccataacttgaaacaacttaagaaataacagtgtgggcttaggcagtcgatttgacggacgacatctcacggagacaatttactcttacccttctttctatattaggcttagtcaatagcttttcgttgctcttcctttgtcattgtccctgagtactataactccgtatcacgtccaccaacatctttctcgtcctccttttatcaaacacctgtccatggtctaaaaaatcaaaccacattatatacagtgtatcactattccaaatggcatctcctcccctagtctctgaaggccaatcatccatacccgtcaggtacctcgcaacagcctttgtgtcggtaattaggtctctccccgagagcaccacggtcacgtcatagccatcgatatcttccttccacaagatattgtcagtccagaaaaagcgccggaatagagtatgtgcgatgcctatatcctttgcaccaaagtaagagagttgatattcgttggctcgttttggtttacggtagagctggaagggcgttagtggaagtgggatcttttacaaaacaagctcacaaagttatatgctacatcgggaagatggagcaggaacgtgattggatcaatgaacaacatcggcccgatcctgggtgcaatccgtggtgcgcgaagaagatgagtggcaataacgctcccgtaccttgatgtggctattgtcaatatgcagtagtgaggcagaacgggtcgtgacaacttacgaatgcgataccagcacaaatttcccccaattatatgcttccagaatgagttcgatctcctcgcatatgtcgttcttgagtaatgtatcaactgttaaatgcgagctgatagacatgagctctatagcgatgatgcctgtctgcccatctactaaatccttgtcgccatcctgggcgcttagttcagccaagaaattcgtgtacgggtaaagtccgacgccaatgccgtggatgaataaaacagggagccttgtcttggatgtgtgcggtcggtgccagtatgtcactgatcttgcaggggagcggcgagacttgaatagattgagaggtcggaaggggaagatctggagaaatcgagggtaggagatacggcagaagctgaaacccactagttgtaagtagctggatgctattatatcgacgataaatatgcactaccgtgtgcggagttagaattctggctgtctgggagggagtcttgctgtataaaagctttgatagaacttacgaagtaccatgtcaaactccgatgcgtcatatcgacttgatcaagcgttagtctcatgcattttgcactgccgcgtccgggctcgaacttcctccccagcagcttctccatattaatagcatactcctcgagctcttcctcgtgccccggatcaagatgccccgtgcttagaaaagcccagcggaagaactccttgacattctctcgcttgatctccgcctcgggtgcatctaggaaccatttcctcaggtagtgtatttcgtcaggaatgttgctgtggcaacgccagaagagcctccggcgactagcacggctggcgcttacggggtgcgtcgcagcggtctgcagatagcctttgcgcagcagatagatgatgagatagaaagccgtctcgagagcaagccatacctccagcgcacgggggagaccgagcgggagatggactagcgagttggccagcgaatagagaatactgaagggggcgaccagttgcaggccgaatatgcatgtacggatgaagatatagttccagatagacgtgcctatcatgacgacggcttataagaaacgctcttggagttgacaagtgtgcgaggttcaggattcgacgattcaaggtctgataaagcaaatggagggacctctggagagaaggcatgcattacctcaagctaaataaataacgccagaagaaagatataaaattaattatacattatcagatgcgaaagcgtacttccgaggtctatttgtgagagatggtaccaaacgagccatgtgtttctatgttttgttggggggcgtctaggtcggaaacggtcgcaccatccatgccccaacaataacaatgggagtcactcaggcatcgattggtcggaacttcgcggagggtgtaccgatgacgcgtggctatttagcttggcactgggttgtccttagatcacgtcacgtgtgatagtagcgtcattattacctccatgtataattaaagccctccaagtctgcgcacgtcaacatgactggaaataccactctagcacatcaacatgtctggactatctgcttaccgcttcccgaaacttcacttgcaactctataggcacagcacattctcccactcaaccgcgtgccgtagttggttcagtttgcagtcagatcgccgcgccttccccgcttatctggttagcccgacggatttggacgaatcccttaaattgagcccatccagggccggcttagaggctcgaataatccctctgtgcgtcgcctggtttccagccaatgaccctaaacatcgcacaggcatcggtgtcttttataagaaacgaatcgtgaacgctcgcttccttgatctcgataaggttttcggttcgcagtcgctccgtccccatatattaccgggcgctgtggagtttgcagcctcaatgagtgagttgggtattcataaggatgatatactgatagtatatgacaccatggaacgtgatattttactcgctccgagggtgggttggatgttgaaagcctttggccaccgacatgtgcacacgctcaataatttcaggctatgggttgaacagggcttacccacagctcaaggggacatatgtggcttcgaccattctaattatccggttcccaaaatcgacgaagcagagcttccaagcatcgaggatgttcgcgaagcgaccatgaactacaataaggatatggagccgagaattgattaatgtatggagccttcttcgacctagttagatatggataggatagcgataacctatcggagctatatgggagaggtagtacgatgttaattaggacagcaatgacgctccgcttcagatctggaatggaagagcgaataagaaatccacttaatttctatgtattatggtctgattttagatgtttacagacattcactgatgcgaaaagacatgttgacaacgaacaagtggtgaaaaccgtggcaggtctccctgccacgggtgtgtctgggatatgcacggccacgatgatgggagtcgattggagccaataggaggtcctccggaatcgccaaccagttacaccccacgctctctagcaatgacacccagttgcacaaatgaaagtgggacatctcgctccgttgaccgttaactggagccaagaccaccacataacgagacagtcagctttccggacgctccaccccgatactgcggttttatcgttcgcatgccttctccagtccataaattcttctccaatctacttgcataggttgtgcggaattaacctcataagcgtcacgaatagagggggtaagactggtgaatttactttaaaggttgcaagtgggggctcatcccatatcttcttcaaagaggaagattcttagaaacactggtcctactgatatttcatgtgaattatatcacggatatactaggagacgtcatcttgtgtctgaagtatctcgctatcttcggccatatcgaaaagattcgctaagatattgggttttaggctatagtcctcatccagagtatagcgcatgagttaatagatatcattataatgacaccaactccttaacaatagtctagagtaactctcaggaagttatgttttagttagagcggcctgcttgaggcggtattagtattgcgattagtcttgggagatattctgatatttagccctgttgtaccaaaggccgtgtgcagtttaataaaataaagtcaaacgggctcatgcacgctgctgtgcccttgctagatttcatcataagctacagtgttttaactgttatcaaggccgcacattacaacttcatttgcggagatcaagtgtatgccctcgagatcatccggttaacaactccaaggcccgtggtgtctagtactcgttgggtgaagaggaagccgttgagttctatcttcttgctgcgcatctgcacgaggagcgcgttttgtcgcctgttcattccatcgtgcagctgcaagaccagaggtcggaaaacggactcatggaatcaggagtagatgaggcttctaaaagatcgtatgtcggttttggtctatacgaatctattgttctcctagcagttgtaagcttctcgttattcccaggtgtagctacttgttggtcacttattcagtttggtccttctctttactggccctatacagatccaaatattactctcagagccttcctggaggcaaggatcctccctctggagtaacagcctccgtgggaagtctaactttagtggtaaaccgcttcggccctgacgtcaattggagccaattatgaccgtataaagactttccctacaataatctctatgctgaataacccatgtccctgccccgaatatctttgccgcaaagaaagctatcacagcctttaggtgatcagctagtcagtttggaaaagaccataaaatttcgcgaggccagagaccaacaacacaagtgcgcatcatagcattacttatctcgtttcaaaatttttttaccaagagataagtatcgtaaatcttcgcactcattcaaccataatggctggttcagcttgccatcaagtcatcgcacattctcctcctacctgatgagcccgagggatctgcacaagctgagcccatctagtatctccctagaacttcgaataatttccccgtgcgccaatttattcccagatgatgactccgagggtcgcacaagtatacagctcttccgcgagaaacgaatcccaaaagcgcacttctctaacctcaacaaggtttttaatacacactgggcattcgtaaggaggcaatcctggtggtatatgacaatgggaaggttgatgttttttcggcgccaagggtgggttggatgttgaatgccttcggccacccgggggtatacatcctcaacaagttcaagctatgggttgaacaacacctaccgatagaaaatggagcgatacatggcttcaaaccttgtcctattcgattcctatgcttgacgaagtaaagcttgctagctttgaggatattcgcgaagcgaccatagactatgataagaaccagaaggcaaagcactgagctaagcacttgatttagagtggagagctagttagttttactcattaagtgggaattggatcattaggggagagcagatctagctttgatcttaaacaaactgtagaagaggcaagctgaaggtgcgcgagaggtggcattattcactacttaaaacccgtgttggtatctatagcccctcactcatgcttgtgcccgcctttaatgtcttatctgctgtgtctttcgtacgatcttgcaactccttcatcgcctgggtcttgtccatgccgtcggctgtctcctcagcgcggtctgccttgattgttacttcgctctcagtcgcaagtttgggtttccagtggccccttccggcctttgcttggagaggctattaatcaggattatctttaagggcagataattgtactcctattattggatgggatattaaaagagtatataggttttgaactatgggtgagaactatttgactggcgaatggagaagaatcttgccttctgtagacttattaagcgccctgattaagcagggtggggatagtccgccgtatcattggcgcacagctctgtatactaaccggtcgtagttcgagcctgttcctaataagagaagcagcgatgatgaagcgggagactgggaatgccgatgtcattgcaaaacatgtaaatattctctcctaccccttagcttcaaatcgtcttgaattgaaaaccgtgatttgggaagaggtttcttggtactatcaaaagatccaagttccgacctaaatctgctggatttgatagaagtgtgacacttcgttgaccctcttccatactctaaatcaaatgctaaccggagttttgttccttaagaaccaaataatcccctggtcgtactctttgcgtccatttactgtgagatggtcaggggggagagcttgtgatagcctatagagaaactcacctccagctcccatcgtagacctttcgtgaatctggggagccgaactgagcctcaattaatgctgtttcaagcacgtatgccgtgatgctggttccgctcgagataatcggctttagaggatccacgcctttcatttcgaatattttcttcagttgatcggatgataagaataccttcgtttccggatccagcattagaccataggggatattgatagagccaggtatatgccccgaagagtccgactgtggagctggatgtcttcccctgaattggccgctggatcgtgaatccagaacttgtataccctgtctaccctccttattatagtccatagttgcttcgcgaatatcctcaaaggtagcaagctttgtttcgtcaagcctaggagccggatatatgcaatggccgaagctgtatacttccccctattctatcggcaggtcctgttcaacccatagcctgaaattattgaggatgtgcacattggaaaaaattgggggtggctgagtagtcaaattgatatagaggactcaaagaatactgtctagctcgttacccactcgattgtttcctatgtttctcctcaacaatgaattgttatctcctatagaggagctctattttgtacaatcattatggctaaactggaatatataaataaagcttgcggagcttcattggagcccaaaaaccttggaggtggaaaaggaagccttatttggcaattgaggagcggtgccgacctaaacttatctctctataagacttattatactgaataaaatatcacactttggttcaataatgcaattattccatcatttcaactaaaaaagattaagcagctattccaagatctgcatgtgggttgccttggcttgcctggcagtctcgccacccttgaggtacggagggtcggtgttgtcgaggagagaattatagcctacgcgaaacgactgcaaaactagattatcctaaaagttgactcagttcccgaaacatggtaaaccctgattttgacttatgttatgtttttaatcttttctatatacatataataaaccagacatgtacatatgtatacagtagttaagttataaaagagatagttatatctatcataggaaataggtatacttgtaccatggctaataatgctcagggtctttttagttggtagtctgggtagctctctaagcccggacgggcctcgaagtgggccttctaccaggattatggactggcgatcctctacaagagacgctagacggtactttttagcttctgtgaatcttggttgaattcgataggcaaagagagactagggagtgcgactgaacctatctatcagggctcagacgacggtaatacctacagtgatcccaaagtgatcgctaacccaaacatcattcaacccgacttttgtttttagccctattccaaagcgacccagttttccagtagtgtcctgagcttcacttagcgcaaacgtctcaatggaccctgtgtagagaaacttgtccaaccgttttcgtgttctagctcggtcagattggtagccccacgtatttcctctagctttaccatatgtgatatctctcctgaagggctttgaggccggtggtgcaggcgctggctcatcctcccagacgtctttcaggtctacctcgggtgctctgtgagcgttgtgctcggaccgatcgaccgaattcatgtcgccaccaaccagcccaccatagattatctgcccctgagacgagtcgcctttcagaagcgctgatacctgcacgagctggtgaaaacggagctctttacctgtgtagagtgattcaaggtgcgttgtgcacaggcggagtgaccgttttaatacttcaaggccatggtcctcggatacgggaatgtcaactacaagggcatctctttccatttcagagatgaaggggacacggaagaaattgtatactggcaaattttgcgaaatcatcatgagggtgaaatatcgacttggtatgtagtcgggctacccgtcagaggattcgccgtctgtgtagtggaggtatggtggttccgtatcggagaggacgaagttttgttgagcccactcgtcctccaggatagcttgtaatgattcttgacggagttcttggaacatgaccacaaggttgtgaggtgcttgtccaaacatagtgcgcaaaataggcgatggcggcagaggtacgagctgctgcagcgggagcagaaaaaaacatgttccaggatgcaattttaaggtcatctccccgcctaactgttctatcttcgttgccggcacgaagatcagctgcgatatccggcgactttttgtagtcaatgaatgccacagcgcccagctctttgcagagttgggccttgtcttccccagcgtctacagcaatgcaaatgattcgtattgccttgccatactgaagtgcaaaggttccaagacctccgcccgcacccacaatgacaacgcattgtcctgggcgagcaccggactctttgagccccttgtacacagtcaatcctgcgcacatgatgaggctacatcttctaaattgcattctgctgggatttttgtcacgtaggcggcttttgcgactgcatattgctggaatgtcccattgacggtatacccagagaggagagctctggagcagagctgctcagctccttgatggcagaagacacagctctggcatattccattaagccacttgatgccaacatggtcgccaatatcgatatctttgacctgttggcccttggcaaccaaatacctgtcccttcgtggccgccgactagtggcatttttcttctcaatggccggtcaccaaaaagggcatgaagatcagtgtggcagacgccggagaatttgacgttgacgacaaattcgtcaaagtccggtttagggactggtatctcctgataaagtaccgctactactcgttagcctctggtgtgctaccgtgatagcgtcagggagacgggggagaggtagaacgaatgtgctcccgaatggtcaatgacttgatcccattgctttgctagaacatccgtagcagccatgtcgacacgttgaatcaagtaaataaaaacagttgatcaatgagtttttgactctaaagaaaactgatggagcttcttgcggtgtcgtaatgccaaaccgactgggcaaagcataccaataaatacaaggaccgctcatcacgattactgcttttttacagcctatgtacgcagtaaatcataactcgtaatgattgatggtaagagtatccttctctgctggaaaccactggcgagacaatgatttaaaggcgacggcccacccaaaacacttccgcccccgtacagccgtcggccaatacctagctttggctcttgacgtagtgcctaccgttgccaaggatgcggttaaactgcatgcacccgtcaaagcacggacgtcactcgtgacgtgtggagacgtttttgaaccaataaaatgcattggaggggtaatgtaattgaacttgttgaaaggtgtgacctacagataggtagcagtcaaaagcacaggaagtatgagggcgggaaacgtccgggagggaattatcgcgtcataataacaaatctagggtgtatatcaagaatagtaaacaaataataaagataaactcgatacgccaacgtggctggcctatatgtaccatcagtacaggtctcctatgatagctagagcaataacgtgcggagctcgcaacagaggcacagagagagaatccaaataatttacctcttgggtccaaagttgacatgtatgggctgtgcttccccgcatttgctcgtgtccaagactggccaattggtgttcgccagcatgagtatccaatcaggtgtttctcatacccccagatcactacggctggtaagcgtcatacgtacgccatcagaacataccagaaaacttgacgtcttcaaattgttgttgttgttccgcgctgcagcttggatgccttcgaagagatatactgctctctaggtatgcttcatcccttgggtcctattttcataacaaatgtgagtgggaccagaaaatgtattgatcgcaccttatatcccaaaaaatgcctttgctatacctccccgtcgagctattgacgcaagtcttggaccatttggctccaagtgattgggggattgtacccgaaaagtgatttggatgtctgcagctccgactagtttgtcgcaagttgagtttggactatgccattctgcgtacctatggtctaaactattctcaaacgtgctaacgcctgagaattacttagggcagtttgacgatattatctcacacatggtgttccaacaggtggatcgtggtgccttcaacgcctcggtatgcgcacctaaaaacaaatacacggtagcatggcttctacggaccataaccaaaatagaggccatgaacagtgacagaatatcctcatattttcatctgtgggcatcatttatggtcacccaatagagctggcagtcagaccgtccgatcagccatgtagaatggctccaagctgcctgtggcgccgctgttgaatcttcctcagcccacttggcctttatcaacttggtctgcgacaactatgcagcgactaccctgcgtcaagttctccaccgtctcatagaccttcagaaagagctcacaggctctgacagtggaaattttctcaaagaagccgacggcgcattgcaactagcggcataccaagggtgctacgcagcggttgaattgttgctcagtgttggcgttgacccgaacatccaccatccgctttttggttacgctctgcataatgcagcatgtgcgggtcattctgagattgttcgcttactgaatgagagagggagtgcttcttacactaggggagcccccgatacccttctggagctcacagcaaaacgaggacattcgacaacttaccgatatttgctcgatacaactcccggtagaagagacaaggactggttaaagggctatttaacacaagcatgcgatctagggcatgaggggattgttcgtgagctgcctcaatgggcagacgcacagaacagccgctcttctcataaagcgcctagatggatacgccgcgcttttggtcgacaaggtaaggagcgaccggtttttgacagatacaccatgaagaggagtacgatacagtacttatggcagcaagtaagaacggccatgtagaaactatcattcttaacaacgcgggatgacctccgtcctcgttgtgaaaatgttagaatatgatcatgattcattagttagattcaacagaatagagttttgtacccagaacaagtacatactctgaatcaaatatagctattatgtcattatctataggaaataaagtattgtatgctataggtgggaagatattgtgcgaattacaatacccgcaatttaaaccttaactaatcgcgctcactaaggaaaacaacccataactaaatacagtggagtatatgagtgccttgggtcgactgccggaggatacgaagcccacgcagtcgagaagagcgatctcatcgagcactatggacactaaattttcctatggagctaaggtgattgggcgacgagtaggcggggcaaacggaacacaattggcggtagtagggtcacggtcacgcatggagggcgagggcggaggagaaggagcaaaagagaccgtaattgataagtgtcgacgtaccaaccctcataagtcaggcttaccagcaacatgcgatttgtggccattacagacaatcccatcggataaggatatgacgatttcggcctcactttcctgagctgccttacagaggctggcggatgtccctcggagagcataaaaggacaacctacagagactaccggttaatactctgacgtgctgtccctgataacggccttgaaagaccatcagacggacacaagtcgggcaaccagcaagggatcagaataagaaacccctgtcgcaagagtgttggtatcaaacccgccccaaaagagaagaaaccttagccaatcgttgtattttcagatgtctgatctacggcgcctctgattgatctagtggcgccctcatgtaccccataagactacgttgtctctctctttgtattggacagtgaatgttaattggttaagaaccaatgaacagtaatatgactaagtggtctagaacaacatttccccattgaggctaagacggtggctagttctagagcagtctacacatagccaagtccatatgtcggatactttggttggctcccgtaggctggcgagattggcgccccggcctgcgataagtcctcgatacaatcgtgcacccctaagtagaccctctttattttttgccacgcgtcctagtcgccaaggcggttacatccatttcaaatggatccactacatcgacaggctccgtagccccaaattgccccactacaggatatactgtaagtggagtggtttgcaatgctgagattatgctttatccaatctaaaattaaatcagtatgacattattcatattccaaggtcatataaggaagatatgccggtggaggatttttgggcagtgccgatgtcacacgatattccacattcagcttttcaccataattgtactaatctgccaaaatgacccgaggggagcgttccctgtctaaggtccactacaaaggcaagttcgacgactacatcgtattcgttggcgatgtccaggcctacaagaagtggctggacaacaagaacatcccccttgctagcttcgtctcccctttcacggtcttcctgactcacacgtaagccgatttctgcatacctaccccattgaaggaattcctccgagccaagatctcgatcgcaagaacctgttatggccttgatgtacggggaaaggcgttggctggtggcgctgctgcagaaggctcatctagctaacaaagtacaggcaaggtgcgcagggcccgtacgacaccgcccccaaaggaactctagcatccgagttcggaaccgaggactcagatgagtcgatcaagaagatattgatggaaggcaccatccaaaccgtgaacgtaagtaaaccagctaaagtggaacactcattcacatcacttatttaacctttacgcttgtgcaggtgcccggccgacaaggcgctacaaacgactcgatgagcccaatgaaggcacattagattcatggacaggcaattcaaggccaggacaggcggagcattggctcgcatgccgtcttttgttcgcgttggatgttgttatgcagacatacttagttggactctttcatctttcacaagagcttcggctatcataatataacagcagttgaagtcagtttcccacgacaagttgcgttgatgtgtaaaggatgagagagaaagagagaagaatttgctaccatgatataggtcttcgcctcgtcatggaaaaatagtcagttcgttttcctcatcttattttgtccaagtctccaatgagtgcttaacggcgtaaagtaaaagaaaagtagaacccaaaaaggaggggtaggcgaagttggtggtgataaaattattacgtgaaaaaaattgtatgtggtcgccttctggcttctgatgcgatgagcgtccctctcttccagtatatatgtgagaagaacaagttgaaaatagtgataacgtaatcgataagcgagcggcacagacaagcgcactttctctaatacctcatataaaaacctcaattaaaataacactagctaattatctataataatagtactagaaactaaattatcagactcctcttcaacctcccgacaggttcgtttattatgaccaggcttaccgcaattgccacatcgcgaagccttcatacgagcctgccctccttggccaccacctcggcggccttcccctcttagctgcttatccatatcctcctggtctaatagatctattccatcctgtacagtaagagagcctccaagccgtacgcggcttttttttttagctcttcgcggcttgcttagtgcctcatttgccgtacgaagatcccggacctcagaacgtaaagagccacctggtgcattattgcagtcgcccctcttgtaaattggtccacagcggctatcatagatgttggagagctattttaatgggctgagattcgggatttaatatgctcagactgtgcgctggcctcgtacgcattctgtggtgtctttaaaacccaaaggctgccttatctcaggaagggtctccggtggtgttggcgttcgtaataccacatcaagcttgaaaagaaccctctctgggttgtatgggagtaggccagatccaataaagccaacctgaatatttttctctataaaggaagagaagaaggccgtacgaaaggcacagagaaactcaagtctcatcaaagttatagagatcctcatctaggatcccatacttggccttcatgtttcgtacgagagcaaaccaaggtgcaataacctttggatcttcgcatttagccgtctgatagtcatatttgcgaacccaatgcgtacgaagctctggttgccgcttaacgaagttagaagcccatttgattccaacgggtggcgcgtcgcgtacgcgtagtagatgattggccatttcttcaacaccacgcaatctaggaggaaatgcacgtgtagatagctcaataacgtacgagacaatagcctcctcttcggattttgtaagattcattgagttagctcgagtatcgcgtcgcgccatacgcttttgctgcagcccgaacgcttagtttagggttattttgaagagattgaattgtaagaataatattagcttcgtacgaagataaagtcatgttgtattattaagaaatttaataaattgtaaagagtatatagattatggggtaagtgcgccgctcgcttatcgattacgttaagtgaatgaatgaatgacgtagtaagcagataagctatgattgttaaagcagacagagtcgtcggcgccccctacagaggctcccgggcgcgcttttagatccggcgcgccctgcttacgggcgaaagtttactcactcttcgtcatgactgcttcgcctgttttcaatgtgatgcttgggcctaagtttaaggaacgcgagacatacttggcatctcttttctttgttgggcttaaagccgaaatccaagataggatttatcagcttgaagagctaccgacgacctacgagggtatgatgaagaaagcaatagatattgacaactagttatatgaggaacgaaagtagaatggtttatgttttaattatgggaagcaaggtcatgtggcaaaaaaatgcagagcaggatagaggactatgcgatgccggttgccaagaacacgtcgattaggcaatgcttgctccctgtttgtacgacacttcaattccagaggccctcaatcatcttgatcgaatcatcattgatattattctgcaccaccgaatcatcactatcgtagccaaagtaagggtcccaatgctcgtcaccatattttcgaactgcaatatattagtaatagtgtcaatggtgcttggtaaggcaactcacaatacttgacatcccttccagctctctcctcaagaattgcataagccggcaccctatgcaaacaaagatacgatcctcgcttatgctgatctgctctttcggggatccttacgcctagggtatctacgagctcgctgactttgaagacataggtttccccgagtaaagatgtttcgatggtgtagagagtccattgctctctgtaaggtttcgatccacgccagggctctgcgcatccccagttctcagcatgatttcggtcggaaaagagcgaaacaaacggggaacggcctcgataactccatgtaagatggcgccccacggcctgtttgaagagagctcgttcgtgttcgctgtcgccgtagactgtggttgtatttacagccttgagtccttcgtcagtacgggtcgtttgactctccgagtattgcacgcggtaaaggttagggggaagctcctcaggccgacaacgatactgattcatgcttgatgactatgtgaagctgagccgataggggtgctggacttagaagggtgaagcttgtcggaggcggacagctctgaccgacgatgggatccaccttacacccccaggccatcatgtgacgagtattcatcgtcggtgagccatagatcgcggggtcgatgcctgtgcgcagctcaaacccaaaataatggtcgaacgcaaacgccaccagcgccctgtaatcgcctgctcatcagagtgtgctatcccatagctgtgagtttaccaaatcgggtgcatcggcgtgtcgttctccaagactatggaaagcctatatacaaggcgagctaaatttaggaaccaccataagaaccattctaccgataaagttggcctcactaacgaatgagtaggaagtctagctaggatgctaacattctgggtaatcttcgatttgcgacctaacctagcttggactatctcctcgatataaccgtaggtaaaacagttaaaggaaggtatgatgacgccatgattaagcatgatgctcgatctggaatattctatactgtaataactaaactctatctgtcctaaagtaaagaagacagtattcctatgtaggaggtggatgacgatacagtgacgagttgccgatgccatagtagggaaggaggcagacagcataacccgtccttattactgcacattacacataatgtgatgttccagaccaagcataaaaatgagccatgacgtcagtatttgatctagcgagcaatcaaatcaacagacgggcgaccgcaagatcagatcaggtcagcgaagcacacttctctcaaattcaacagatttaggttagaacttggatcttttgatagtaccaagaaaacctgtccctaaaccactgttttcgatttatgaaggctctagactaaggggtacgagagaatattcatatattttgcaatggcaacagcattcacagtcgcccgctccattgtcgctgcttcttttattaggagcaagcccgaaatacgactgattagcacacagatctgtgcgctgataacccagcggactatctccagctgcttaatcaggatgcttaaaacgtccacagaaggcaagattcttctctattcgccagtcaaatatttctctcccgcagctcaagacttaatgctcttttcatatcctatccgatagacggattctaattctttacccgtaaagataattctgattatgggaggcataagcatgacagcctctccaagcaaagggccggaaggggccactggaagcctgaactcgccactgagagcgaagaggcagtcaaggcagaccgcgctgaggagatacccgacggcatggacaagacccaggcgatgaaatacttgcaagatcgtacgaaaggcacagcagaaaagacgttaaaggcgggcacaagcatgagtgaggggctatagataccaacacgggttttaagtagtgaatagtaccacctctcgcatttatgattgtaattcactttcctagaacaaatcatagatattccgctaggtcatttagtttatgcactgacctacgcggcggctttaaatgtagctttctccttcgtcgaacacctttagcttccccaacaagctcaaaggttattctaacaagataactacagattattgcaattatttatacgtttgcggttataatcaaggaagaagggtggtggaaatggcttatcgttctcaaatgcgtcgaagtaatcctggttgttatccttgcgctggttccaaatattctagcacccctcgaacttgcctacatcgcaccatttacttctcaaatggccaccatcggagtattgtttctcgcttctcgaaaggtctcatttgagaggaagccaatggtcgatcacttattgctgctgggtttatttgtcatcttaatctcagcaacggtaatggggctgtcgctggctggtcactacacgaggctgatgcttccgcaatggctcttatacatggcaatatcgactgtgggctaccgggttccaagcactccgcgtcaaacctctcctgtacatttggacatagagctcggggtggctccaaccgcccgtctccatgacgacttgaattcaccgcacttgaatagccaacaatcaacttcttcattgctcagagttcaaacaacaaactctctcgccatgagcagcaattctgcgagtcagccttgaaggatgttaaaggtgcacgaagcttagagagcaaaaggcggaatgaaggcttgactgtcatcactactcaaggaccagaacttccgctaggagaaaggaattatctcatgctgtaatcgtgttcatagctagctagttctgagtaaagacatccatttcatctgctttcagtgcttcatcgtgtagttgtgtaatgaagtacaccactgcccaaacgccatggcttttcacaccttaacccgaacgccaagtgtctttgcgcaaagtgccatatgacgacttatgaattgcgcaaggacggccgctccggtttgtgagagtatgtcgaggagggcagctactgcatgcacggaacttttgggggggggtacatttgatggatatcttgcttccatactgctatccccccaggggttggggtcgtagccccttttccattacatgacgctgtcacgagacgggaccgaggtgggcaggatacgtattgcttatgacaccgatggtatgccttgccattcgttaccgacagtgtgctctcacccttgacctcttgtactgatcatctgcacgtgagcataattataagagggcggatttccggcagtacacggtcactcaacagtggtgtatcttcagccctttcctgggcagtctcaacggtcgatacaatgagcaccgactggcgtcatgccgccatcatgcctcttccccagaaagccttcgagcagtcattcatcatcggtaaagaggagctggcagccaagagtcttggaaaagatcaaattgagagcacaaacgactccggcgaaaagacaaaatccgtaaagaggcgaagagtaagcgaagaaagacctacaggtatgaaatagttacgtggccaaatgtttagaacttgatggtgtaactaatatatctaaaagtgaagcgccacgaagaggactcgttacctacgccatgaaagacaggcagctatgctaaagggccgctggaagttgaacggaaagagaggcttgtttgtgaggagaagtataggatatcctttgacacttccatgcagtctttcgatggcattaaactcagaatgtctataaagggatggagtttggaatacgtcactgttaaaaacgctggaagtcatctcaaagtgcgtgtgaaagttctatcacttatctgttatagctttcctgagattctgaaagaccaggaagcagttgtgatgaagaatgaggagtacgcattgtcgatggaacaagacggacaaggcgagcttcagggctagcttttggttttatccataagttgtatcatgagtctgtttccatagcctcactagaagaggatcacttgatggttgtattaaattcgtatgtttttgacatgtggtttatttgtatggttaatggtatggtgggtttagggtaactagtgcataagagactggtctcttcggggcccatcaatcccttccggaataataactccaccaaaaactgctgagagaaatcgcgacaaccataaagttagcattgatgcaggagctagtattgtggacatgggatgtcgagggttatactccttatttatgaggaggagtggcagattgttttaactgttctcatagcgccgcgctgtccagatagagcctaggtagtgtatgggcacttgaactggccaatcatatgacaggtttttaaggtgctcccaatgtgcaggttgtttttgattggcctttgaataccagctataaaggtgaggataagtttgattactaatattgaatgtgtaagcatccagtatcgggctattatggttccgatgcctacctggctgtcctgctattttcctccaccgccgccttacagcaatctgattatcggcactagccacccaccctccttcgcacaagttattaggctttatgacactgagatgctgcggaagccactagggtgggaactgcgcctacgcgaagcggctacggtcgccctgcaaaagtaactccgacggccgcgccacgacacgtgaaagcacaagcaacgcgacgctattaacaactcactgatacgctgcagcatggatcagactcacgccagttttaaaaagatggaaatgcagtctctttcccctttcaggaggagagcggcaggttcgattgcaaagaattacgaggacgcaaagaatgaaagctgcagggtccatagctcacccaagaggtcactgaaatgcatgttccttgtgcttacatgtacaattttagctttccatgtcctacgggagcccttgcgtacgctataattaatttacatttagccagggaataatcccagcgcttgctctatttgccctgcgatcaacagggtgtattaactgtctatctaagtcgttattgtgtagcgctcgtgacctccaatctcggataatagtccagcgacatcactccgtcttctcacgcccattcgccaatgaacaagagtgactagcttccatacaactcctttctaccccgacattagatatgcaaactgcgggcgattgtggagcagactacgcttccgggagtgaatcttgaggttatccgctccatgtttcctcttcgtcccagatactgcagagagctgagagtgttaagggctgctcgaaggacggcgcggtcgaaatcaacaagcatgacacagcggtgctcggcattccagagcaggttggcattgcgctcgtcgctgtggtcgaggacactcgtgctgcagactctcgagaagatttgaccatgtccccttgccgacgaacgtgtagccgtatggcgcaagttccagtctgaacagtacgcctatcgctcccttcttaccccacccgtctaaggcacggcaatctcggtatgggtcttcgcacagccgcttgccgactaggcaggtgaactcgtcggcattgataggatgccgcgtgtcaactccgcccgcgacacgatgagagagcgcattaggacagctgtcatcaagaccccagctcttcttgaggcctaacagacaagcctgcgagcagtattgcctagtgggccctgaatcaggcattacggcgtcttcttcggagctgctatccgatggaccgaccttccgtttggccacatccagttttgtccgcgacgagggtaagccactttctggctcctcctcttcatcgctctcgttatcccggcgaagcaacgtcggggcctacatgatgacctcgaccgcaaagagactacccggccagtcggggctgccctggatgtgaattcatcccctcgcagcggcgacgatgacggcgccagtgacgactccgtgtcctctgccgagaggaaatgggcagcatcctcgtacggttctggccacctcggcagtgccgcgttcgcgctctccagagctgcttcgagaaaaggcccttgaagcgcattggattcgagacttaataagagtaagctggatagctgagccactgctgtatagatcattttgtcggcccagttcgcaaccgacatttcgcccacatcgtgtgttagctgtagccacaactttggcgacagatctttcgtcttcggggctgtttcggaagtcgcatttgcgctgcgtgagatttttgcagtcttcacagatcatggtatccatactgcagcaaggtccggtccatatgggttgggcgcgaaaggagattcttacccaaacaaactatcgtgcacgttgtatgcggattgtaacccaaaacttgccaaggcgcgtcgcgggccggtcactcttgataaaagagcaaggttcttgttttgatgagatcagtggtgaaggttcggtgggccggcctctttaaagtctgcgtgctgaagcaggctgcaacatctaatctattccgggctataccagcataggttttacctcttctattggtccggaatcgcgcatttgctgccatgacccttaggcaaccatgacccttaggcaaccatgacccttaggcaaccatgacctttaggcaaccatggtgctacgtactcagtggaatttgtacgaagagaatgtactgaatactccaaagagtgatagcgaggctgccgggggctatcaagcattacgtgacaagtataaaaatattactaaacctttatcgataggtatctcttcactaatatattccgccttctatatacaacaggctcctaaggcaatatttactcttgatgaatccaggttagttgattcctccttgagccccactttgttggtctttaaaaagagtcatggagagacttggcaactgggaagtgggtctgggtgcctttgttacgcgcttgcttctctggtgcggagtgtgttctctctcgtctggtgtagggagtttgacgaggcattagtagatgtagccagcattggcgatgccttcaacatggtcttcggcgcattggtcgtctcgttatcgttataaaataggcagacagaaaaaaaaaaactggcgggttgagcggagtatattaggccaactaccaactacggggaggggtaaagtgcgactggcctgggattgccttccgcttgctttgtcaaggagggcgcggaagaaagaattcttcaaggcataacactgtggcttgatgtggcgcagaaattgtggtgaagtcggttcgcacggaccactaagtgatcagagcttgagacaggagaccggccccctacggggcccgccagcagacctttcggaacgagactttctggactacggaaagatagttgttgaaaccaagataacgattataagatgactattttatgaagagatgtaaagagaacatattcaagagaaaataattcaagagacgctgtcgcgcattatattttgattagggatagcattaataaccatctagtggatgtgatgtggctggatctttgatctcattggtgaaagataagattcacaagacggctctgtaacccaccagccttcgaaaagctgtgggaagattaccaagagaggcagaagcaggtacgggttgataaagacggcgaggaagaccacgatgattagcgggaaataaggttacccgataaattgtaagaaagcatctgtgcttgatcttattgttactgttgcccggtatcccggccttcgtaggtgtatttcgttcttgtagcgagacttgagagtttttgcatcgcttcaatgatagagtggtccattttgttcctgataaaatcctgactacgcacgggattgagcagcttaatactatccagtgtcctgtacctcgatagctgtacatagaggctggtgaagtcgtacttagatagctccctattggtgatataattccctcgcagctcaagaagaacttctacgaatatcttaccttgagccttataatccgtgagtacaaatacgggtacgacgggcaggctgcggcgggtgcactttgcaggcagaaacctataattgcggttagtcggatcgagggtctgcgataccgagcggataagcactgttcccggcggaagggttggtatagataggctcttggtgtctttcgaatgtaaaagtataccgagtgatggtctgaagtggattgttatatcgtcggccaggtggaaacctgggtatttcggatcaggtgcgaaattataggcggtaaactcagccccgttaacgatcttgagtccggtgtaaatattttgatttacaaccacgggcatgtcctgggcgtagaagaatataccgggaactttgcagctggagtcatctcctagttcgatagtccttgccacctggtcttctgagagagtgccacctcgccaggtatatgcggagatgaagatagaaatatatctcttgtgagaccgagcccagtcaacgacggcctccaggctaagggaccagcggtttcggttcagcagcgttatggcacgtaagcccgtactgaagctgacctggtctcgaccgacaagttttgagttgagcatgagaaggtcttgatatgtctgagccccggcccgtactctatcgagcagggcacctaggcgaggatcatctcgtgagcgaacctgttcttcgagaaggaccactgtcttgaacatctgctacaagccgaagccacgatggtgcgagatggttccttgtcccaatggcgcggtagaagggtctatcgttttattgaccaggagactcatctcacgaactggagcgaactggtagaagtcccccatcaggagcactactggaatccctccaaacggcttatcggtacagtctcggagtgactggagattgcggctgacctcgtacaaagtggcgcctccaagcatgctcacttcatcggttacgagaactaacttctgcttccatgtccatttcttcgcttcggagaaaatcaggagttgtttttgggaggggcgatgagtgtccagcccacaagcggaatgcagggttgtgccgccgatctgggccgccgcgcttcccgacgtaccggtgatctgaagaagatgtgattggccccttgcctcgaacacccattttagggcgtcgataactctggacttgcccgttcctccaggacctccggtgtactgaagatgctggccggcagagtcagggtcagcaatgtatcgatctaagaatttgcacacaagttgaagagccattgtctggagggagttgagggtaagggacaatgcggcagcgcgtcccacttccacaaaccccgttgtatgatcgatttcgaccgccatccgagggtcatggctgactaactctagacgccggggtggaatgggaatgtctgcgtcacagtggcggacaagtatgtcatccaagtcctcgcttcccatcgtgcctgccgccgcttgaggaccactctcgatctcatcgagcatgcggagatgcagcatatcttgggcctttaccgcggcctgcacatcttcgtaagagagagccggatactggcatagtgagctcttctgggattgtcaccctggatactttacttggtaacctcaactcccatccactacaccataagggccatcctagcaatcgtcgacagagtgatgccttaacagtgatccgcagcgtgcttctcttgctcaagtcccattgacagccgattaccctcgcaacgatgccagaagcccaggaccacttcactagccgtcattatgacgctgaacacagcaccggcccgctcaagtctctgaatccaactaagcgatatctagtcgccgacaagaagctaatcgctgggcctgacacagggcaaattcaaccgccagcgcgacctagtgctcagcgtcccggagtcgcttatgtctagagaagtcgagataataggaaaggacggcatgcgctggccgtcagtgttgatcctagaaaacatgatgtaactgaaggcccaaggccatcgaatacctagaaccagactctacgtggggtttcgaagatgcttctgagatacccagtctgggatgtgtcttacgatgtcgcggtcgtcttcactataggtattcatcacctaccggcacatgatgattgctaataaaggaacagggtcgatcatttgggttattaatggattcttctcctggctgcccgtccaagatccctcgacagagttctctgactgggctggcggactgacagcattcatcggagctactgtcttcgagtttggttcagtgctacttatgttcgaggccgtcaacgagaaccgctcagactgttttggatgggcagtggaagaaactgtagatggtattctccatctcaatcctgcacacaactgcaggcattcgcatgcccaaaagcggacatttgtcaagggaacgaacctcgtcaaacctagttaaaatcgaagaaagacgtatggaatcatctgacagtaatcggatgtggtcttggtggccgacgtggtacgaactgagaacgcactacttctatgagataggttttctggcctgctcctcgcagatgttcggcgccacagtcttctggatatcaggtttcacagcactaccgcctatacttaacagcctctctacgccggctgagtacggggcctattggctgccccaagtcatcggaggcgcgggtttcatcgtctcgagcacgctcttcatgcttgaagtccagtcttgctggtacatccccgcgccaggggttctcggatggcatattggactatggaacttgataggggctatcggattcacgctgtgcggcgcgctgggctttggtaccacacagccgggtgtcgagtatgcgcttacgctgtcgacgttcataggttcttgggcatttcttgtgagtttagcggtgtttcgtgggaggcatgggactgactcgagcttgcagattgggagtgtgatacaatggttcgagagccttaacaagtatcctgtctgggtagatgaaaaggctgggcgcctggagcggcaaacaggctgagtccgataagcttgggctcgagtccggcggctaatacatgccgcctagatgcctaaactgtgagtcccattacgattatcttgacagcgatgcaggtggggttaggcacagattgtctaaaggacaaggagtggttccagaagggggccgagtactctgctcttgtgtcgcttggcattccagtcattatcatcaccttcacacttctcctatttgcaatcttgtttatagacaatgctttcgcaacggtttcttattggagaaggaggtttagggttatgatgcaccgaggaacaaacgtttaaagcggacatcagagttgttctttggttagggtttcagatatgatagcaccacgtgcgcctcctgagtgccgccaccttgaggccccgtactctggtaccgctcgtggcttacccctctcctcgccgcggcacccctcaaagagtccgagtctgggtgcctggtaatatggagacaacaggacttcatgcgtcttgatgcggaaatctcgagttctcgtgggcgacgtctgcagtcatggcctcgatggatgatgagctcttcggaaagaccaccaggtactgcattggggtagcttctaattaataccacctgaaggcaattccagattgtgcccaatagatcaatacaacacccttcgctggcgctggggggccttgccgggcctagcagggtaagccaggcgctcaggccagtgctgggcctgctggacccctctgtgggcgggctttgtttgcaggccccgcagcaccgtggctcactatggcaacctagaggggatcaactcgctccccggagccagccaagcccattgcggcctgttgattgttttcgcgcgtcactccattgcattacctcagtcgcctgtccaatttccagcatcattctcctgcacagaatagccgaattgtgttcgattttcttgtttttgtctttttggcagcgcgcaacaagctatcgctactaccccccaaatgatatacttgctacaggaaccgcttcgttttctttgcctaggctcctgaatttgtcttggaatcgatcgcgctctcactgaaatctgtatgttgctgccaaacatctcttgcgcggtcccacgcgactgattaggggagcctgactcctctcttcgtcactttttctcccctcttctcttgagtcattggtcccccatctgtcccgtccgcatcgcacttgtcatgtcgatctgttcattccttgatcgattgcggggttcgcattgcgaccgttgagctccctgagcttgttgctaacgcgggatgataactagacgtcgatggccgacaacaaagtgaccgaggagcaggccgcggagctcctaactatcctccacagcgacataatcctcgacaaaaaagtccagtttgtgaccaacatcaagtcgggcatcaagcagcataatgtccctgaaacctgcgtcccccaactcttcgacggacttcgcgccgccgccagctcccagcataatgccatcgtcaatgtcggtttcactgccctcaaccacctcctgaccaggctgtcccgccaggagcccaagcttctgaacaaggaggctgctcgcactctacccctgatcatcgagaagctgggcgaccagaaggacaagtaccgggccaccgcaatgcaggcgctcaacacactgtacagcgtcaaccccggcgatgttgagcgcttcatccgcaattctgccatgaccggcaagaatccccgcgcaaaggaatcagccatgcagtggctgctgcaggtatgtgccatcccctgaagcgaaacgctatgcgactatagtcctgactttcgacaagacacacaaggagcaaggtctccagttccgtagctacgttccgttgcttatggacttactggaagatgccgacggcatggttcgagatgttgccaagagcaccgtcattgaacttttcaggtaagatgcccccttttagatagtgtcacattccggggatggataagactgatacgggactgaataggaatgcaccaaacacagcaaaatctgacctgaagcgacaactgaaaaacttcaaagtgcgacctgcgatcgagcaagctattgttaaggaactggccccaaccggcgcccgcccagagactcccgccaatgctgcgcccgccgcccgacctgtattagccgcgagcgtatcatccatgtcaagcgaacgaccaatcactcccgccgtcgatgtcagggccgagaacattgaacctcaatacgtcaacacgaatcgcgaactcgacgatatctttaagggaatggcgtggttctttgagggcagggagtcggaacagaactggatcaagagagaagagagtatggtcacattgcgacgactcaatgctggcaatgcgacttccgacttccccgatacctttctcgcaggcctccgtggaatgcttgacggcataatcaaagctgtaacctcgttgagaaccagtttatcaaaggagggttgtgggctagtccaggatattgcggttgcttttggtcctgccatggacccaatggtggagcttctcatgcaaacgttcgtcaagctgtctgccggaaccaagaagatcagctcccaactggcaaatacaactgtcgacaccattctgagcaatgtgacctatagccagagattgatgcagcacatctggatcgcctgtcaagacaagaacgtggctcctcgcacgtatgcgaccggctggctcaagacgatgttgaagaaggaggcccaccacaagagccatgtcgagcacacaggcggagttgacctaattgagaaatgtatcaagaagggactcggcgatccaaaccctgcggtcagagagaagacgcgatctgtgttttgggcattctggggcatatggcctcagcgagctgatgtgtaagtctcttggatcttttctttgtcacaatcgaatgaacagtactaacccccgacagaattatggaagatctggacgcaacagcccaaaagcttctgaacaaggaccctagcaatcctaacgcccctaagaaggaagacgccccccctcgaccaggactggggttatccaggagcactatgaccgccagcaaaccaagcctccgggaaacgatgatggcacaaaagaaggcggcacttgcaaccaagaccttgcccgcccgaccagggtctgccatggctcatatttcacatgtgcggaaagtgtcggaccccaagccaccaagtggcgcttcttcatcgaagccttcagggagtagtagggcacgccctgaagctgggacagtctctgtcaatgctagttcgatgtcagtcgcccccatgcgcccaacaaggaagcgacctgaagttgctcctcgacctgcgacggctggtccttactcggttcgagatcgtggcgagcacatcgaagccgagagccctaggaccctcaaggctaagctggcaccaaaacctaaggagacgacgcctagaaggacagcccaaaggacccggcctgggcacgcctcacacgccagcgagtcgagcatagcctcccctgttgcgcgaccgagatctgtagcctcgaatagagtgagtccgactcgacttaagaacacgcagtcagcactcttgtcaagcagccctgccgcgaaactgaacgaggatctaacactcgttgttccccaaatcccccaccctgaggcaactaccgcacaacaagccaacaaagttgaagaggagctcgtcaaaccacacgttgaagcactccctgaaacgcccatagaggcacctgttcagattcggtccccgtcagatgagaccccacagccagtgaaggtctacgaagatccctttgtcgatagccaacaagagccgaaaccggcattcactggctcagttctcgaggacaagcctgtgaacgaggatgccgcgaatctacctcatcccaacggtcaggctaaagaagccgacgatgtcgactcactagacaaggccaacaaaaacgcacgcctcctggacagcggaatctccaagatcaagctcaagtcgcttgaggtacatggcttccgtaagttgcagagccttcttcgcgacagcaagacggtcttcaccgacgacaaattccaagctttgctgctcggcctcttccagttcctcgaggaccctctgtcgacgatgccgtcagacaaggcgcaggacgtcaaggcacaggttctcaccaccatcaagctccttcttaagagagagcgggacaacttcaagcctcacgtatccaagtgcctcgagtccctcctcgagacccgaagcaggtacgagggacgtgcccacatcatcagcggcctggagctactggccgacgaactcgtcaccctcggcgacccccccgagatcgtcgtcgtcctcggtaggaaactgcagggttgggacgacagcacccccgagggctgccgcgctctcagcacaggcctccacgtcctgaaagccatgctggagaagcaggaggaggtcgttctctccgactccgagctggcgctgctggtggagctcaccggccggtgcctggagtcgaccgactccggcgtccgcatggacgcggtccagctctgcgttgccctgcatgcgtgcgcgggcgaggagcgattctgggattccctcaaggacatcaaggaggatccaaagagcctgatcacgtactacatcatcaagaggcagcgcgagaatggcggcgttgcccttgcttaaggtgcgttttcgtagtttgcgggaaagacaaaaggggcagggcaaagcattggcgtttttctttttctttttcggcactgggcattgattggttatggatggacataaggtaaaaacagtatatatataatacggcgctgggataagttgattgtatactgtagcttagtggttcgagtggcttgaatgtatgatatatatcctattgcaataatattttatcccgaaattctttccaacagcggatggtatccaaagcctttgcgggacaatccaagttgcatggcagtactggcagaatcacgcgaaagcttaacttctcgggcttcacttctcgggcgatcagtcaatttatgatattgcattacacgtccacatcccatcataagcataaaccttctgaacaactagaccgtcccaaaacatgccgcgatcctatatccgcagtatactacattgcatatagacaagacgcatcgagaaagactagaacgacaagaagcaaggtgaattcaaacagtagctatcgtcaacgtagaaaataaaaaataccaccctttccgcctttccaggagggctaaacaggttcccacccttttaatcaacgcaaccaattcaaactccaaagccatgagatggtatataaggtgggaggggttatagatatagaaggaggctaacaaaatgatgtgaaagatgaacaagggttgaaaagcaatcgggtaaagagccggcgtgaactggccaagcagcagatatgatacacttgggccatttcaagccccggctttcttcataacagcaggtgaaaagctcattcacatgggaaaaaaagggaccatgtcaaaccctttggagggtcccgtataatctccaagtcatcgcccttgttctgcgaagacacaaggagatagcgggcattgtgttagcccgcaggacgcgaagtaaatgaggaaccagactctttagccaccatttcaatgttggcgttctgtaaaagtcggcacggatttcatgctcttttctccactccaggagcgtgctttatgtgatggggttggaatatccagaagcagccgacacagcaactaatcaacaaagatgttgcggctattctcaatgatgaactgcactgcgaggttcttggagtgcatgtctgtcatttctctctcgatactgcgatcgaacataatcgtaggagcgaagacaacagccaagttcttgggagtcatctgatttgacgagtcagcggtgtgaaagtgaatactgaggttatggagtcataggcttaccaggttttcagactggcgttgagcaacacgatcaagatggaacatgaggaactcaaggcaatcacggtgcttctcaggcatggaagcaatagtccggcgcaaatgttcgcaacgctctgatgggtcaacaattgctaggcgacattagtttagagaataaagttccgaagggtggatgtgtacgtacaagttgattccagaattctgtcatatacttcaaaagtgagaagcgggattggcaacttcctaaagtattgtttcaaaacgctggtgacggctgtgatatcccaatcgggatctgaaatatcaaagttctcgctcctctcgaagccatccttgatcatgttgacttgggagttgcctcccgtctttcgatagatgccctcttggtccacacctctgagctcaacttcttcgatgcagcgagtcaccacactgggtatctgacgacgctcccaatcagctcgctcagacaaatcggagccaaaaagggtggaaggagcctcgggggtaacggccgctggcacgctgttggcagaagctgactttggaacagcggatgccttcttgctgaagaaaccgaatccttgttggggatgcttcggttgcctgccttgctgcggcatcattggcgcaggcgtagttgatggctccggaggaaccatagtattgttgtagggaatgccaatgtcccctggaccaatggccccgggcccaacttgttgaatacgctcaccacggtcgttttggaatgcaaccacagcacctctaacacccttggcgacgttctgggccaatccctttgagcctttcttccagttgaacttcttaacctggcccttacggattggtaccgctatgggaccgttctccacaatctgatcgtcctcaccaaccagagtgtgtccagtcgtcatgctggcattgtcgagattgatcgaggatgcggtagctgccttgttctcgccatagatgcccagaccgttgcttgacttgccatcagccacctggcttctgaacttttcttgcagctggtgcgtcatatcattgttcatctcggccaactgggcgttcttcgaagaaagctgttcaaattccatcagagcatggtccctgtcagcggacgcctgatctctttcttccaccaagcgatctcgctcctcgtggagttgttcgatgctttctgccagcacgatcttgacttcctcaagcttctggacaaagtccttgatagctgagtcttctaattcacgaggatcgatcggttttttggaatcctttgcccgttcaacgtagccggcgagcacctcgagctgtcgaatcatgatctcagtttgagtgtccagaacggaaactgtcttcctcttctcaagtagtttcctgtcaagattctgaagatccttttctgtgttgaactgcttctcaagttcggccacgcgttgctcggatgtccgcaattggcgcctcaaaatggtggtatcatcgggcgacgagaccgacaccgggctcatcaaatcgggtgatgcccagcctcgttcctcatgaagaggagctttgggccattggggcgaggcggtaccccgagttgtttcgctgatgctccgagtgtgacttgctcgagttggtgtttggttcgagtcaatactgttggtacggccgtgtctggcgacattggacgcccgacgcagaatgttggaggaaggctcatcggttccgagtattctggccatatcctcgtccatcgtgaaatcgccgccgttactccatctaggaagctttggagacggtttcggtgatccctgttcatctttcgagcccgcaccaggcttcccagccaacgaaggcggtggtccccgtgggctagcatagtcggttctggaactgctttggtcggcagctttgagccgtggaggggggactcttggtggagggacatcctcatttcctgactctctacgttgggggccagcctttgtagttggtgcagctgtaccatccaagtcagtaaaaaagaaccaagtccagaaaaaaagaaaaaaaggaagaacttactattcctagctgagggaggagagctatctttacgagtgactggttttccagtatcaggccggctgccggatttcgggttcgagtctcctgaccctctcctgtcgtccgcctctggctttctcgtgtcttgggagaatcgtgaaggcggaaggccagcttccccattcttgcgtacttccgattgtgaggtagagtgattggccttcacatccacgccaccgtcatgaatcgaggaagaactgctgctggaagaagtagccgctttcctacctttgggcgtctggcctttgctatcatcagtgttggtttgagatcgtagggcagctctttgttgtctatcttcactcggaggagatgagtgttggtctgacctcgacgtcgagggttgggaaagcttcgatgtcggggtttgagctgatgttaaatcacgatctgcagattgctgtctacccttattctgaaaggcgatgtggggtgtcgaggatggggagtcattccgcttgtcaacaaaggacgacttggggagattgaaataatccttcctctttgtactgtcattattgatcgaatttggagttggtgccggactaggatctagagccacggggatgaagaacccatcatctttctccgttgaatcgctgcccgtcaacgtagagctcctgttgcttcgataggtatttccagaaaggcccagaccatctgtcttccccgaacgctcgggagatctggcgggccgggagctatctcgtgaagcggacgtggtagatcgatggccttggcgaggtctaggcgaaatttccgttggtgtatcggaatcaggatcgaccttgtcattggagaaagcgcctttggggatctcgttggggggaagcgctgggagcgacttctcggtgatcatgggagattccttctccctgctcttagcggatgccgcagccttcgatttcttccgcttcttagcaatgatagtttcgtggcagcccatgcagaagattcccagcgatgtccttgcgtatctcaggttttcaatcttgcgtttgcagttgcggcagcggaagcaagtggaacagaaagcctggtcaccagtgagaatggccagatcctcaatcttgttgccacaggcactgcaactgtatgtgcagttgctgcaaatgagcgagccatcgccgaggaggagcaggtttgcgtcggagtcgaggagcgtgtggcaggtgttacagcggaaacagtcgagatgccatcggttaccggctgtgaatggggacgatcagcatatgctcaagcgacaaaggaacataccagtccgcaactgggagcagttgacatgcgcggggctcgcgacaccgaacgaggcctgtgaggcagattcccaagagtttttgaggatcatgctccggctctcgtgtttgaggaagtaactcggggaggtgtgagagggttccgtggcgggaatgacaaagatcaggttagggaacagtggctacttaccaagctcgtatgctttgccttcctcgagaatctgccatggaagtcagtctatgtccagtcccgcaagtagcaacccccactttcgccaactcttgtatgaaggtgattcagatctcagggccgagggtagattaatgcattgaaacggcttacctctccgcaacctttacatggaaacacatcttcctgctccatggtagtgtcgagatactcgtcaatgatggcggccatggcgggcaaccgtggcgtcgctcagcgatgccggcctgttggtaggaaagtgcgacgtaggatctcctatatcagcgaagatgaagagggaacgcgggaaggttgcaagagacgctctcgcgcagtcgagatagagtgcccgtcggttgcagtggctaggtatgcgttggcaggagaaatgtacagcggcgaagaatcgggaccatcgatagtgtttcaatccagacgggctgcctgaccgggggataagcgagcgacgggggcggagagcacgatggtagggttgagcgaggcgaagacgcagactgccgacgacgtgatactcaggcgtggagggcacgagcgggcgaggagggatgaggttcggatggaagcatcaaggaagaaacgaagcacatgtcatgaaatacacaagattgggacttgagtaagccagtcgagttgctttgccgcaagaaccaccaaaaaaaagattaagagatgataaaaaaaagagtcagggcactcccacacaatccagctgcgaatcacacatccaatgagcggatgattgggtgttgagaggatggccaggccgagacggtgttggccaagctgctggagcgggacggggattggcaccgcctggtcgaggggccaggctaaaatgtgccagacgcattccgccagggggctgtccagccagtctggagagcgggcagcgggttgaggtacctggagtacaagctgcttgtacagatgtgtacctggcttgactgggtccgcaccatcgacagcggtcttacccaggctagcatagtcgctagtggctcccattttaccaggtgtctacgccgtgctaataatccaccaggccagccacagatcatgggccaccgcccctccatgaaccgctggatgccactacagaacaggtacttccacacatggcaactggcgaaatgggtggcttgaattgagttggctgctaggaaggaaggaccaggcttccgacggaggcacgcccaggaaggaacaaaagaagcatccatggcggctagatactgttctggtcacggactattcgacagcaactcaatccatctcgcctgccctgtatgcctctgcagtagtagggccaagggcaaataatccccgactccgcatcaagatccatccattgccggccgcctctggcccagctgccctcagaaacacctgggtcggaagctaggcagggagatggtaattttaccaatgttgcacaacggttcagccatcatctcgctgtttcgtggcgggggagcagcaagattatcctgcctatccacgcacgcatgttacgtatgtacacttcgcgatgcatatctggctgtatcttgaccgaatggattcaagccagactcggcgcattccgcctgcagggccaacaaccccagatggcctacttaggcaaatcacacccgatacttctcaagtcccaatgtgtacgtctctcaacccacaggcgttggctgtgtctattgagctatggagctgctaattctacgagtcgtatcatgaccatgtttgtcgggggacttcctctacaagcagctgccccgttgaggaaaacagacttgaagctaatgccagggtggccagcacgtgttatcacaattctttcaattgatgaagagagcaccccgacgctcgtgggaagataatgcggctcatggctccatcacctttgatacagcacggaagcaatggatatagctcaggccaactaatcaagctagggaccaatctccaactctcctagagctagcggccacaaacttgatatcaatccattgctaccagtgctggtgcctttgggctttggggagctagactccaacaagattgattcagtgtcgtcaaccttagggcgcggacggtgatgatgcaaacccgatcaatcttcaccaaagcgtgacgcccaaaggagctcttcatcagcaagacctaggctaatcattgatattaggtgctcccttagctcctcgtaatgatgtcgctcaggggctctctccactgttcgaagagtgttttagtgggcttctcttgtgtgaggactctcgatggggtctggtttggagctggggtcctggtggggtagacaacctgtccttaaacaggtacctgccagtacctcgccgagaaggcctgtaatcgccctgctggtgtcttacccctgcccggcccagcccttctcgagccctgggcgtgcttcccggcgtgggctaggtgtcaatccttcctttgctgcaactgtcgacggcggcgattgggaggcaactttttgttccatggtataattcgcaattactgctgtgtagggagtgccaactacctatccaggcatggttggcagcgctgggatcgaaggggagggaacagctgtgattacactcatcatactaatcataagccccgactcgtgtcgactagagccgactatggagggcttcaagctgatggtaacagcccccatagtgtatattcatagtaaagcagtaagttgtattacagctcctttcatggcaactcggctgataccatgtcagaagcgcttcctgcatagtaggggcagctccgccaattcactggctttgagcacggactgtgatgagacagaacgcaactccagatggtgtcgtggcttcggttcaagtctttgctgaagaacatgagcatagagacgtgtcgttcattacccacccacctctgaccctgagaccaaccagctgtgtctatcggggaatgagtgtaatatgggcccaccacacggaccacccaaacccagctaccttcaactaaaggtcgcccgttgacagagatctttctaccatgagccgtgggctggggtatcactgtgtgcggtttcttctcgccgtctctctgtgtgcgtctgtgcgtatatacgcacatgtacctagcctggatgtcaaatatcgtgtagtagtattatgcgccaccacattcaaccagcagccagcagaccacggtgtgcataatcggttggcgtctaagcgaatgggtggtttccgtgattgtcatcttgcacatacggcaaggctcgttctactcgttctccgggtatgctcggcttcccttctcgcattgctagggaaggctggatgacaacgcttgctctcagctcagctgattacggacatacgccttccccctttatgcacgcgagaaaagccagctcctaacgttaggtgcgttgctgcttaattaggatatcatctctaagccagataccaatcactcggcattgattactcgtggagatgttatctgctctcaagcatctggaggttggccagcagcccagcaatccttgccaaactggaaccaacattctcaaccctctgactgacccgtttcatctattcagtggctaaccatgccctgccctggtgtggtgccttgccaggggtcacgccaccatccttaccgatccatctcccaaaccaggccaatagcctcaatccacaccactcatttcgtggcgcaacaacttgtaagactcacagctctggtgaatcgaaatgaacgtcgtattcatgaccaacgggggattattgacagaccgtcgggtcttgcgccccagaagtaagtcgactctgcctccaccaagtctgagaacgacccacagccagctgaaccctcagatgtctttcttattttattttttacattatttgctttccttcccccaccggcgagggaacttggtgaatgtagcacaaggcattgtcaaaaaaaaagaagagtgacatgaagtgctgtaggggacagacagaccccttgagtaccaggaggtcactcatttgcccggcaatagcacatcgtttcaagcaataaatcggcaggcacaaaaacttaagcattcgcatgtttcagatggccccttctcagctcacgcctgcagcgtgcgcactctagttccatccgcattgcttggtcctcgcgcggccagtcacaggccaaatagtgcgtggctctcgccattattattcggtttcgtttcgagccaagtttcccctaggtgccattgggggcctggtccctgaaaaccgtggttgaaaccgcatgaaacgccactagtagggcgctcctctttggacgtgcatatcacatctgggctgctacattggacttgatccatccgcaccgccattcattaccgctgaccaagaggctgaaggccgtcaaggtctttaatttccgcccgcctgtctcatctgcagcatgtaggtacatttgatatgaagaagcacacagcagagatacaaggtggcgggaggaggcaggtctgcatccgagaaagagggactgctgtttcactgcgtaagcgcccggctcatcacttatcctgtcaaatgtgtcatcgtcccgcgttcctaatcccagcgcagaatgggtcggtggatataggatgtggaggaggccggaatactagaatgccagatccaggttgacgaacgacacgttgtctcgacttgaatgtatacgtccctgtgtcaatgccaatggctctattgatttcaggcttgtgatggagaaccccccccccaaccttattatctccattgtatattcggcttggacagatggctactaacgtactcccaactggccatgacttccacgccgtctaggaacaggagcttcttcatggtgtgtgttgtcgagatccggcacataccaagatcagcattacccaccgaccacctggaacccatcaactccaaacacgtcgtctgagacaatacagacgatcttccgaaacggttgatcacttttgattgccatttctttttcagtacccgccccccgtcacacacccccttcagcacatcgagattttttccttctcggccgcgaagctattgccttaggagaaacgtgccgtgccccagctaccgatagtttatcacacgacagcggcccacctacagacatacccagtcattcgccaacctgtgtgaatagtgccagagcaggcggtagaaatcaatggttccgtgaaatattatgcgttgttttgagaaaatatgatgggaatagcgtccgccctcctcggcatccggcgcctctcgctcacttcctactgctcggcaactattttccttaccttgtccagcagcagactgctctccctcccgagcttcttcttcccgtccttgccgatggtctttgccattgctctcttgtaacgttccctctcggcaatcttcttctcacgctcctccctgcgccgctgaaactcctgtgcccgagcctcactctcagcgcgccgctcatctgccttcctgagctgcttgtcgtagtaacctggtcgccgagtcctgcggcgttgtccatcgctgacatcatgctgcttctcggggtcggagcccgcttgtgccatgtcctcgtccttcagcatgagctggcgtgtggggtgaagctgttctggctcatcgcccccagacggcttctccgtttcctcgttgtcattgccgtcatgatcatgatcctcagccgaagcctgatgctcctttccctctctcgccttaatcttggcgtagttctttttcagcttggccttcacaataaggccctgcttgattttggtaactgtaggagtatgttagattgacgaaacaaacaatccacatgtgagcgtagatgagagcatgaatgagaaaagattgaggccgaccttttctacgccagggtccatctgggaggttgtcagggcctactcgaaagccacgccggggtttctttgcatccggagccttctcggaatcctcccggggtcttttaggcgccattttgtatgattgtagctgggatggcacgcagctatggctggattgatgaagctggagctggacagatgagattcagttgcaagtttttgatgctgcagccagtcaagatacagcggggcccgctaaaagaatggatgtgtctacaggggatcgacagttgagcctccggacgctttacaagctcgccttcttcacagaattcccagccagtctgcttaagactcttccggagattttaggctttctgctttccgttcgtcgaagatctaaacggggtattcatgcgccgtcttgtgttgttgttagcatgagatagaccagtgaaagtttacttgagcaagtagcaggtacctaaaagtacacgagctttgggcgcaaaaactgcacccataggggcaaaagtgctgagccaatgtactttgcgggtactctaaacaccatgtgctatcccgcactctaatttggcaccaatgacggcacatctcgctcactgcatcttctccatcatgacggacccatccattgcattagcctccacgggaccctgatggaacgacaggacctcaccgcacctttaaagacgttgggcagactctgccgctgtccagtgtccagagagcagattcgctggctaagtgcttgcatattaggaccagaataaaacgcacaagttatacgtgtctgtgcactcgtctgattcatgcagtgaaggctctgcctaacctaagccgacctcgctcacgagacatgggcagctatcttatcgcctagccgcccccagctcaactgaccccaaggtttccaacttcaagcaacaaacctcgatacctggatttgatgatagtttacgactgcctacctatctctccagaaccgcagcctagctgtggttctgcctttctgccatgcccatcttccaagacgatctctgctgtagcagcgacgctgtcgatcacccgtctcatcccgaacctggctccgagacgactccagaggccattaccataccgcatgccgcttccaagaccagaaggctctccgaggagagtttgcgaaccgagctatgtgaggggccagtcctcgaaagccccagggagtcaccgttcaacacacccgccgacgattccaccgccacagcagacagagctgagttgattgaaaggctaaagaggggacaaagcccgacatggatccctaaccgccatgtacgacccatattgcctccaaatacaagtatcacagcgttcgctgaccagaagggttatcaggtcatttttcagcaggacagaccagtcagtccacctacgagaccgctgagaacgccttcaagatcctccaacctactcccggcggcgaagattactccagagaaggacgaagactccacgacgatagcagatgtcaacctacgtaatgggctgagcatcgaacgcccaagatcggctctccacagcggcgacttcacgcatgacacttcgccagacacgaagcgagatggtcaagtacagcaggcccgagtacagacagaaatcccaccacagaatgactggctggctacatctcccccaagggattatacacccttccggtttgatgagaggagggctttttcacagagaggcacgcccttatccgcaaccttcatcacgtccccggtagctcgatctccgtccttctcctctagcttcgcctatcaacctcccacaagtccactggtgcagtccgagagcaatgacgagctggacctttctgaccccttgggaagcatcgactttgcgtcgggcagatatgcctcgagacgacacactctgtactccaacttctcgtctccctatgcctctccatctccccgagggccgtcctctttcgcaggacggatggccttccatcgccgtgaaggctcactaccataccaagcacatcaaccccgaaggtcgcttacgtccagctcgagcttcaagcactcagcaacatcacctccgaccccagccatgctacgacgcatgtctttcggctcggattcgtccccgatccagcagcatgcgtccatggtcgggtcttatgaggagagtattctgcgcgggcgcatgtctacaacaccctcaaaaccgctcgacttcctcgcccagatcggcgtccttggcatgggcaaatgcaagcccagcctgaaatgcccagcccatgtgacgctgccattccctgctgtgtattatagctacagcaccacgccccatggccgctccagcagcgaggacggcccaagcccctacgttggccagatagacttggaaaatggcctgccaaacatggctgacgaatctcggtcgagaagaaaggcccacagcaggattgctgatcgtaaatcagtcgaaggggccggcgaccccgtaacggcgggacatgccatggatgttgaaactcggcaagttccaagacccaaacgccgatcagcctccccgagagcaccccctgggggcagttacaggatcccggaaaagggccagatccagattgtgataaaaaaccagaacaaaacggcggtgaagctcttccttgtcccgtacgacctggagggcatggagccggggaccaagacgttcatccggcagaggagttactctggagggcccatcatagacggcatccccaaccacgggggcgttggcacggtagagagaccaactcttcggtacctggtgcatctgcatatatgctgtcccgcaaagggccgattctacctctacaagagcattcgtctcgtctttgccaaccgcgttcccgacggcaaagagaaattaagaaatgaaaccacatggccagagccgcgtttcagcccctacaagccaatcagagtgatgcacccaccgctctcaacctccaacgggccgggagccatgcttgccgctgagaaggcattcaggaggcggagctcagggttcaccatgggtggcgggcccccgcccctatccctcgacatggtggacggcatgttcgcccgctcctcctccatgggcggcgcatcgtcgtcaggcctcggcatcagcaacgtcctccccctcgagcccatcccgctccgcctccctgggggtgcggcgagggaccgccgccccggcagcgaggtcagcgagagcgcggcggccgagttccgctcgccgcagtcctcccaggccagccgcccgtccaccaaggactcgtccggcgctgattcatggggcgtggcgtcggcgtcgccctacgcgaagctcagcaagggcgacctcggctacggcgggaacttcttcagcccgcttgggccacggcccgcgggtgggggttccgagagtcttctttcccagcgcctccggtctctgggtgtcaagcccggcgaggcagagctggtgtttgaccatgatatttaaaagggcaaccttggtcgtcgcttctctctccaatagagggagattatatatgcccacccaatgtacaatagtgagtttcgctctggacgttttaacttagaaaaaggtttggggttttcggtgccattgctttcttaaaactcatgcatgcccgcctactaattccatcgacggaaggggttttctgcaccccagccggcacatttgctcttttccaaatctagaatgggtttacattggagttgaacgctgctttctatcaggttggcgttgggctttgatatttggtatttgatcgctggcaatagcagctacataaacaggaaacatgaacgacccatggcagagagatacattgagctgaggttaattacatacataccataccttgagagaatataacacacaaattgaacatgcaacatggtaaaatagtccttgatgaattggaaagaagcgattatattctataactgttggcttctatgcgaatactatacatgtatatctacatattacaataagagcttacaattatccttatcatacagtttatacagtcgttgaggacggaagtaacagtcaaaagccatcctactgcggcaccgtagcctcatctccctcgtctagctcatcgaggtcgtccgcctccgcatcttgttttgcactgagtgttgtctgcaagacagaccgaagttgttgcagctcggcacgctgcagtgccataggggtacggctctcctcatcaaccctgaggaagtgagtgtcgtccggcccggcatccagctgcttaagcttgatttgtttttccagagccttctccatccggagtagttctgccaggggcagcggcctgagtaaggcagagatagccttgtccagctcagcctcgcttccgaacacccagcggtcagactgatctgagattttcatttcggcgaaagcacggtgcaggagagggtacttttcctccatgtccataagtttacgcgacatctctcccgaccatgcaccaagtttccgggcttccatccactccttttgcaacgccatgatcatgggcttcctgggatggaggatgctgggatgcatctgttcgcgtcggcgattcaagggcggcttgggtgggttcatgcctctccactgaggcatgatgagcctctcacaccagtccatcgctgtttcccattgcccgaattgcgccaggcagcgaattacccgatcccaggtgttcgatgtgagcttgaatccaacctgcgtgacttgcttcacgactttagccagcccgtcgccatctttctgggcggcaaatgtctgagccaagcgggagatgatcatcgttacatcgtattgatgagtaggataaatctcattggtgcccagtttgacgtagcgatcgagtatcttgggccacattgctctccatacttcatgaacccggtcgtagttctcgtcccgatgataggcaagcatcaatgcactgacgatgtcttgtggcatcggctcacctgtcttgtactgtgggaacatatcagtgaatatcgtcaatagttccccgacagtaacaaactgccgaaattcggtcaggagtagtaccgctcgccccatgttggccgcatcttgctttcgccgcctgatgtccccaacattgagtttagcgttcgggtcggagggccgcagcgaggcgaccatgctctttatcatagcgggtgtgcgcgtggtattcggcgctgccttgagagagacgtaggagtgtgccactttagcgttgaagggcacggggatggagttttcctccatcaatctcatcaaactctccgctatgccacggtcaccactccgagcagctcccgacatgaccatggaaaagtgatccggctgcaaaatacgcagcccatccctgacggcatctcgcacaaccacaaatgcaggtccaacttgattgaccctaatcaaggctctcaaaagacagccgatggtgtcctggtcccactcgaatccatgttgtttcatttgatttaacagtaggtaacactttgacagccgtccgtacatgccattataatgcaagagctggttccagattgccgtgctgcaggcccctcgctgtgctagctcgacacagatattttcggcttcgaccaggccatcgtttttgcagtatgctaccaccagagatagtccaatttctcttgaaagggggacgtgattctcttgggacttgttgaaaaactcgatggtcgtatccagatcgcccagctttgaggccatagccatgacgtgtgcatatgtaaacgaatctggggtttgttcctcggagatttcaccgaagtaggccaaaaccttctggtagtcattggccctcatgtaacatttaaggagcgtgttgtggatatccaggtcaggctcaacattgtaacggttgatgatcctgtcgagttccttctcggcccccgcaatgtctccattctgtgcgtaaacattcatcgtgcttcggaaaccccgtggagtctctacgctagagggatattgctgtacgtaactatcccatagctgacgtacacgatccacgtctccgcggaaggcgtacagctttagatatttctcataagcccactggctcaattctccccaaaatcggatccagtcaccgcgaagctgttcgaggggtgcgggattgaggtcatgaaactgtagcttgaagacccctcgcaagacagcatgggacggctttgcccctgggagcttcctgaacgcttggtaaatgcccaaaagcgtgcgagcggtagctttagaaatcttcttcatgtaccattgatcaagcatattggtaagatagtggtcatacaatatgccatctctccagaaagccaggatggtggacgcttgggacggtgggcacaactgagccaaagcctcctctgcaaatcgtcgccgaaggatacgcaacccagacttggagacagcagaacggtcaagttgccgctcaacctttctccggtctttcgccaggtatctctcgaatgagtagtagagagctcctaggtttgacaaggatgacaacggggacaagaggtgctcatctggctttttccgggtattgcccggcatgcttgcacaatgctcgcagtaagttatccaagcatctaacagaacggcccactgctgtttattaaccgagtctacgatgagatattcgatacctccaaccagacctttggcatctactccactcttgaagatatcaagagccgcctgttgctggtcagacctcaaataaacaagtactgctgaggatagaaattcgtcatcccattgttcgagttcgacctgccggatgagagaatttgaacgtccagcttcgacaacactgcgcgatcttgatagatatgtaacaactcggggtcgaaggaggatctgctcgaccatgttcaaccgacagtacaagtcccaagcatcgtgataactatttccatcgggatctgccaacaggtcgttcagagacttgcttatcgaatggaaagacggactcgggaggcgattgacatcctcctcggcggtgagtgcgacggcgtctacagtggtattgagctccttctcgtcctggatggcgaacagatccttcgtcctaagctccttcttaagatcccattggctttcagccttgccatttttgataacagatagtaattgagcttcaggttgctgggattctgcaccatccaagttgtcctccgtgttgtcgagagcttttgccgtaccattcgaattgaatcgcttcccgccgggagactggatacacgggttgtcaatcctacttagaacattgagtgccttgcgaggtcttgccaggtcatggcggttttgtcggaggagggcgtgggtgggcttggggtagaggaagtcgaggaggtcggtcgattcgccacggggacaggcatgttgaggatgaggctccgtatcagggggagcggcctggtggctggacggccttgaatggctgcgcgggagcccggtcaacaggcgtccatgttgctgagggaaaccggcagcatgtttcctcgagtggtgtgtagcccgggggaggacccgttgaagcttgcccgtctcaaaggtagctgctgccctttccagcatagctggaaccagagaggtggctgttggcgaccttatgaccaggtcggcgtcggggggcgggcaattgcggtcgcggggtcttgatcctgtgatcgggtgaaggcgaacatgatatcaagaaaaagattttggacatggagtacgattatcaggcgttgtactggagagcaatggacggggtaggccaatgggaagttgcgtctggcctgacatgtggacctaaaaacgggcaactggagcgctgaaggttccactaaaaacatcgccatagggatcggttcggcatgcacggtgattcacttagtgtaagttgagactctctaccggccttcgccactcgataatcaatcactcggagaaattgagtttgagatgtgctatttatgcaatttattcaatcagtgcggctgtccaggccgagctagacagctgccacttttcctagtattagcgcagagagataatgacatatcgtgaagtgaaatcgaacgcccagaacagcccaactacattgatgtcgaggaaagaaagataagcaaagaataaaagaccaagcagcgattccaatctcgtcaggcgcaacgcatttcaaacccaattttcctagccaaattcatgtgccaccaaaatccatagtattcgttcaacgttattgtacaagcaaggttcgtttgtgtagccctctcggagggacctcatgtcgtttctcgtggtggtgccattatttatgatgcgctcaagcgtggataggggagcaggacaggccctcctcttcaggtctgttcgttggtttcgagtttctgggcatcttcagccaggacctcgttcctcaggctggatggatggtccacagctcggcgggcttgtgggcctcggctgcagcttcgtgttctctgtccccgccgaagagatgccgtcctatcagaccgagatgggactctggatgggcagtgctcccgtcggctatcgcggactcggttgaggatgaacagatggcggttgggggatttcaaggaaggcgacgggtttcgtgagtaggagcccataggcgaggaggcgcgatggcgagatcggcccctcagcgtgcttgattcatctgctcgctctgcctttgagccagatggcactcgccggcgatctctggtacgcccccgcatgttctcaagcatcttggtatcgtctgcaatgggggatttcatgtggttgttctggtggggtgccttcgatgatcttattgcttctctagctctgccggagaactagaaagaacggcgataagttcagggagcttgtctggatttatgttggtgtgattagagaggatggttgctttgctggagatgccgaaggtaaatacaacacacggttagagccggagggtgtggttggatggttggatggttggcagtggattattaagagagggtcgaggtaggatttccttttggggggaatgtcccttttatgctgttcagtaatgagagaggaagatggagagaaggggacaggagcaatgatgaggaagcgaaggggaacttaaagcgaaccagggagcaaaaattagtttatttacttattgctagggggcatgaaataacttggaatgagacactcccaaacgccatcttcaatcaccttagtgaatacgggtcccagggcattgacagggtcagctgagcaaaagccaccaaaccaccagagcgccatcgacacccggtccataaatattaatgctgtttctttcggttagaggccgtttgagtcaccgctaacagcagccaccaaagtcaactggaacaagccagaagtggccttgatggaccgggggcagcgcggcaacggggcggggagactcccaaacttccccaggagaggcctggtgatccttttgcatgtcatttggtcactagcagggcccggggtgtacgccggcgggctcctggatcctgggcgatgaccaagctggtgggagcgagcgtcagggagcgtcacagaacagttgcctcagaccgtgtcagggacgtgcccatacggctatccgggccacgtcggtatggatgtttatgtgaaaggtgggatgttgttgaaaccccttagacatgcggcatgcatcatcccggcaggaatgtcagagacctcgtctaagtcgcaaactcgacaaatgtaaaaccgcctctcatttctcgagggttgttccagcatggtgccgtaagcaactgagtccaaccgacgcctacctacattctggacccgacccaaaggtaccgtctgcctccagcacgagtatggtcgggcaacgcccatcgtagcacgaactttgttgcctggccaagcaaggctggggtagttagtcggagcctaggacaggccgatagtcagcgacaacgtcaactggagccagtaggcgtcacaattctatgaatatacagaggtgctacctgacttacctagtagagatgggcggatgcctggagcatgcgaagcacatgatcatgcggaggatcagcgcaccgaacagccatcggttgcccccaggagcctacccattaccagatggccattgtcatcactccattgaacatactttccgctaggccagggcttagcgatgatggtcacctaagtttcgattgcacggcgataaaacagcatcagcggccggagagcgttatctcatagctaccacccctttcgcatagaaaccgcaggcctactgtcgattgagtgcagggctgttccgattccaggaggaagatatcgatagaccccatacacccttcggagcacatgctcacctactcggaacggaagggaagaggggtaacagagggtagcacaacttcacatactgcatgctcctctaaccaaaaaggccctaagatgggcggtagacaagctagcgccggggatatagcacgttttaccataggccgacagcaaagtgccgtcgtagtggctgagcgactggcctaattagtgggatgaactctgtaggccactccgtaactctcttacctggacctgttgctgcttgaacgagtactctactgtgaaaaggcgaactttggtcgaaatacctacacaaacaatttacctttccttatcggtccatcgaattgacattttgttgcaactctaaaaatacatgaatagagggggattgtcgctttctggaacacttcggttccttccaaatactgggggtcgaactaaccccaacccaggctgacctcatgatcgatcgataaagtcacaaccatttaggattttgttatctcctttgcgcattgcctcccatggacctgcttaagatatatttgccacgagatctgcatacattccttcattcatagagtcgcagcactgtaggtgtgctgcgtaaaaggtcttagatgtatcttcgcttgcttgatacttttttggatagattgaagaggaattgacctgcaccccttaaaccagggaatcagcgtcatggatatttctccttttgtccgttgtaggtctattcaagtgccctgcagaagttcaatgaggcgctaattcgcctaaacacacccaagctgcgtagtatgctgaatgaggagaagcgataggccaggaggtttgacgagagtctcaaccacatagcgaggcttaccaccagtaaaggagctagacgagagcggagtcgatcggctgtacggactacgttggctcagataagcctagcagtgcaatgatttattactggttcaatcgtcattagcacatcaagcacatcacgtttcaaggtgaataggggtgggaggggcagtggattcgtgtgttggaggtgtttagtgtttagtgtggttgacaggtgtttgaacgtagcaacgactttttataacatccatgctaagaggtatgctaataataatttaggtattgggggggaaattcttgaaattcgacaccttcaaaaaaacagatcatcagatttcccagacattttcctgaggaatccgagtcaaacaaacagataattagtagtcatttgatagggccccgtacccgtcccctgaatggagcagttcgcgctagataagattgtctccctccttcacgtgctggcttcaactgcctctacgatggtagcgggatgacgacaggttgcatctgtgattcccggcttttttttttttttttaaattgtttcacgcaacttcctactgggcctcacgggcatccattcgaagccattctccgtcaatgaacttcactgtcgaggagctcaccttgtaggaggtgacgacaggccattcactcctttattagcttcgcggctgtgcttcggcaccagatgcaggctgccacgacgcctgtagctcagacgcgccgctgaccacccatgggcattccacaacacaacccaggaccgacatcagtgcttcgttatcgtatcggccgccatgaatttcggtagaaacgccgcgaccggctatgaacgcctggcccaggcggaccagttcagcgacgaatccgacgatgagctcatgggccagtcctcagcctcgctacagcaccctccccctcgtttcaaccagacgggccagcctcggcaccgctcggccgcacacagccctagagcttcgatatcaagacccaagttccgccagcgcgttgggagcaatgccggcgtcgacctcaaagccatcaatgcccggctcgagcgctgggccgacgaaatcgcgtcccgcttcaagcgccgcggaagagacagcaccggccaggaagagcgctatgagatccatcattccgtatttcagcctcccgatggggtgcggcccgtcacgatagaggacatggcggacctgcaacccgggcacatgtcgagagccgagttcgaagcaatagtcgaaagcgtgcgggtggcaatccggcaagaggtgcatccaagcatgatctctcaaggaagctccggaagttattttgcgcgagatccggatgggaagatcgtgggagtcttcaagcccaaggacgaggagccttatgcagcaggcaatccaaagtggaacaaatggattcatcggaatctgttcccttgcttcttcggaagagcttggtacgttctagattttgcgttcctatgatcgcgtcgtcccagcttagattactgacatgttatgaacagcttgattcccaacctatcctacgtgagcgaagctgcagcttatgtgttggactgccagctgcgaacgcacctcgtcccctataccgatgtcgtctggctttcttccaaatcatttcactatcccttctgggatcgacgtaaattcagaaagagaaagacgcctctgccggcgaaaccgggcagcttccaagtcttcctgaagggcttcaaggacgctaatgtcttcctccgagagcatccgtggccagatcaatattggtctggattccgcacaaacgatacgcacagaaacaagagacaagggaaatggactgagaactgccgcccttcaagcggtcccagattagacgacgccgaatatagtgacggcgaacacaacgaagagccaacaacaccacgagaccggtttgcttggtctgaaccgctgaagcaatccttccgggaggaattggagaaactcgtcatcttggactacataatgaggaataccgatcgtggtctcgataattggatggtcaagattgattgggagactgaaaaagtctcagtggtatcagatcccattcggatgaatatggagacagtggctgaggaagaagggcaagggccacgaccggttgatttgagcaatcgtcccactagctctgcaccaagagcatcaaatccttacaggagtcaaaaacccatggatgccacaagtaccagggcagtcaaaggcgcaccacagatctccctgggcgcaatcgacaactcgctatcatggccctggaaacatcctgatgcttggagaaggtgagtgtaaccacacaagtagacgtcaattctcagaagcaacgctaacaaatctgccacccgaaagtttcccctttggctggctcttcttacctgtcgatctcatcggccggccattttctcaaaagacgcgagatcattttctgcctttgctgacttccgccacttggtggagccaaacttcattggccctcaaacgagtcttccaaaatgataacgacttcaaggagagaatgtttgccaagcaactagcagttatgaaaggccaggcctggaacgtcgtcgaggccttgaagactccggatcacggtcccctggagctgacccgtcgtaccaaagtatgcgtctgggacgatttggtagatgtgccaatcgcagtgccaatgcgcatgacttcaaacgactcgcagcggaatatccagccgcgcgacagcatggatgaggcagacattgctgggtcagtgcctgcaaacccatccaaagttgacgacctccttggcctgcactcctctccggcagacatgccacacccagggcggttcgaagtcaccacgcccaacgacgacggggccatgtctcctgtcaacgaacgccacgcctacgcgtcctcgggcccggccccatcacggacgagcctcccggccatggagcgcccttcaatgcaccccaccagcagctaccacagcgtaaacccgcccctcaacccttacgacgctgctcggcagaagcaccagcgcaggtactctaccgcctcgggatcccaccacaataacctcagcatcgctcagcagatttacaacggcgacgacctcgagggtgacatcggctacgccgcggcagagggtcaaatggggaatcaacgaaaagttatcgtcgagcgtctcgaaactgtcaaaacaagcccagttttcacctggtgctaacaagcctgtacaccacctctttttctctctctctatacaatgttgtagacgacgacaacggccttgtttttccttttattaaaaaaaccagaagatggctttgtactgtttttttttccctcctcttcctagagcacaaccaagggattgtctgctgagccttgtgtaccgccctctcaagcagtacacactctacctcctgcatacttctacaatagacatatctccgaactggttcaatgatcgctaacgtctcaggacacacatcacgttacgtatgagaagggtgttttcggtaaatggcattcggagacttatgagcctcggttcatcatctagttcaaaggtggagactttcgatcgccagtattatttctgttttcttatcaagtttcgctccggagcaggagacgcgcatgtatttctaaagggtcacaaaatagatggaacaacaggggattcggagggactggatagggggttggcatcacttcatggattagctgcggggcgcttatttcccctagaaatcaacacggacctgagggagagaatgccaagtcctttacgctcccgattattcctgtgcctggtgttgtctcagctcagtggcgcgccatgactcataagcataagccgaaccacattgctggagccaggacccgactgtttggttaggtctcagggcaccccctggcggttcccattaaagcgcgctattgtcatcatgcctattacgtgcctacccgttcagcctacccagataggtattaatagacggtggcataaatttcccgccaggcatgctcagctcagcgccaccgaaacatgaccagtgtggtcgccaagtcgagtacatatttcctgctgattagcatgaacatgacagaacaaccacctcgtctgcaattgtgcgggaggcccatgacaccacagtgcaggaaattgcgccagcacagcactaataaggattggatcgtctttgctcgggcggaagacccacatgaaagaccgccaatcccaccacagcgggccgcagcggccattcccatctcagtccatagccaggaccttcctgctagggagggtcaacagatgggataatcacttgagaaacgcataaaggacaatcttactttagttaacagtaagatagctcttactagttgggttcatcaaataccgcaacgggacgtaacgacttctcgaaagatgtttcgtcaatgtgaggtaccttttgagcaagcacagttgatagcccgccatgatacgtcgccattcccagttagcgaggagcagccgtttcctagttagtccatgggaactgcagcttgtgctacacttcctgactgaaactcaagcccattccattgtgccccaacctgccagcacgccattaagacaggaaacttcttgacccataagcgggacatggaaaactgtgtcgtttgagtggatcaaagcaggggttctatgcagtcaattatgaccttggggttcaaattgccgctagcaccagatgtgtgatgtgtgcggccgaataaccagactgttgggtttgagggacagtacggggtgctccacgccctcaatcgaacaccacaataatccgcattgtgtccctccctcggtccatattgccacagttaaacgcggcccttatgaaggactccatgtcctcggtcgaagccgaagacagttcagatccaccatgtcactgtctcatgcattcattagcctgtatccaccgagccatggagtctgctggggtcgctttcccataatgaaagagatgaaagagaaatgtgatgtagagttcctacacctagcggcatattcatgtctgactctcaaggctgcttttcagctctgttcggcctctccgggttgtgaaattcaggtcttagcctaaggtgcctcatatatagcctcaatcctcaaggagggaaacatccgtcttccacacttcgttgaggaggcggtgaagagtagttcgatactactgaacccaaagagacaggaggcggttgctttgcttctccctccctcgccggtagcgtgagctcgttgccccgtttttctcgtcaagcccctgctatctggatcctaattcacgactttgaccagctgactttgcttcagctcctggttgggatcgtacttccaatacaagccgtaggtagcgaggatgtgatcacacattacagggcctgccatatccaaatggaggatccgagttgatgatcatggaggctttccggcatagatttctctttccgcctccgcgatcccgtcccttgctttcaaacccaagctcctgggacgccgtagacagttttgtgtgcgctccttggctaagaataaaaaccgctgggctgcatgacctgttcaacattttacttccctgtgtgtgggttcttagcagcccggtgcgtgagactgcccccctcctctgtccgtagcactaacatccttggccaagtttttgcgccacgctggcttgacctggttttcgctcctggggcttgcagcgacggtcattgaaggataccaatctccgaatatttcccccaaggtaaagcttgtaccgtaacctggaagaccgcaagactcggcccaaattagaggcgtgcgcacagggcagatgtgcgttgccttaaatgaacagtgagtggtgtaggctcttagagcaacaacaccgactgtgcaatctgaaccaaaacaggaatgaaatcagatcaacaaatagactcatgatgacagccacccgctgacccgatctgccattcagtcaggatccacaggacaaagtcttagctgtgattgtgattcatggaaaggcggctgtttcgcagtttgtcaggtatgtccatgtctctggcatcttgctgactgtccgattgcgagaagtactcgagatgtataagggcgccatgaaatatttctgtcaccaaatcatagactgacactcaccctgtcatgggtatgaaactaagcttgagaaagatagaagcgcgctcggtgcctgcatggtcaagccttcaataacttgcccaattcacgcttcgctgccccagttcttgtattccccccattcccgtcccttgcccgcctatttcacataggtattggggtggaccctgggtcaagccagcaggaccaggcaccaccggagccttgatattatgtgcctccagcctacgatcggcagtataatatatacgacagattcggtggaccgttcatatgtgctggcagtatttggcccctccccaccagttctatgggatccaaggctcagcgtctgcatatgctggcagttgcgagccattaagggacgaataagagtgccttgtgcgtgcgggagggcataacgctgaatttcggagccactacacgacgactaactgtggacagcggttcgcaaagacagccaaacctcaaatccctatttccctggtctataccttttctccaagtccagaaacttaacaggcaggaataaaagctcaggaacacttttagcctcgagagctttgcttcgctttgcgtctgttgattgacatggagccagagtaagaatccacgaagggtgctttggacggagcacaactaacagctttagtgacggaacagtccctctggacgacacttttgctgaggtcgttgagtttcatggtcgaatgtaccaaaagtatgccttaaccaacgagacatatttctcaccggtggatgaggtaaatcggatctctccttcgacaccatattcgactaactttcggcagagagagacagcgcggctcgagcaaatgcatcgtatctttaaccaagtgttcgacaatcggctgatattcccccccgttgcctctccgcgcagagttcttgacctcggctgcggaggcggtgattgggcatcagccgtagctgaagaacttccgagagcgtcggtaggttcaaacatccagagaaaaaaggtgatattctgtgttatgcaagggctcatagagaacccaaggtcctaggaatcgatgccagtccacacatgttgccggaagatcccccagataacctcgagttgcaagtagacgatttgaatgcaaggttgaatgacaatcccagactctttctgaatcttgacgaagagctaactgttgccattctaggttcacattccaatcggatcgatacgatattgcccatagtcaaatggttgcaggagggatccatgcaacccgctgggaaagctatattcgggacatatttcgtgtcctcaaaccggacgggtggtgtcagatggtcgagatatatttcaacgctcaatccgacaatgggagattgactcggggtaggccaaagcttcccacaggagattgccgatggctaaccaagtgtggtcacttcttgcagaccatgcactctcgaaatggtcaagtaattacttgcaaggagtacagccttataagaacccccgggcgccattgcaaatcgccaactggatgcgcaacgccggcttcacggaggttgagtcgaagctgctggtactccccatgtgcggctggtcgagcagcaagttccccgtgccccgatgaaagctcattcgaattaactgctgaatcctccaattaggccctcgcgaccgagcaattggacaagcaatggcgggcaccatccgaaatttgctgcatacgataggtttatatccaatggtgcattttaaagggttgatggcgagccccgaacgaaacgtgatgaaaatatccactgacagcgttgaacagaatgccgatagaagaatttgaaattttggttgaagatgcaagcgcggaggccaatgatccgtcgttcaaggtgggaatacccgatatccaacctctatccagacacgttgctgaccacgaacgattcgaatataggcatattttccattgtaaggagcagtcatgtttcggtctcgtattatgggctaacagttagataaagatacgtgtgcatcggaaagaaaccgagaagccgagcgaggtaatgagcgaggttgcggacgcagttccctgggtagcccaaccattgctggagatgaccaccacctaggcatcagcatttcaataattttgtgggatcgcgtaaagattgtgcggcataagaaggggaaagagacggagaaagggggttttgtgggagaaatggtttgggcaggcaccaaccaacattcagagcaagagggagcaagaccgtgggtcggaaagaatgggcaccaccttcctgtcaaaggcatcatacctactacctcgagccctgccccgatgtcgcagtgctctccaggcacaacactgcgggcagcatggcacctatgtcttaccttgccgacaagttgattttttggaggttgggagggtaccaaggtaaccgggaagaaaatgtgcgttgtatccagggactattcggtactgaacacggcaatagggatgaaatgtggctccagcagttgtatacccctaggacaatcaataagaaccttgccttagtacctacattggcatgttatcctgcggctgtgctcgaatggcgtcttgctttatgttgtatgcaggaccagaacgccacacacaatgcgccaaagcaggcgaccggtatctatttgtgctggtcggggggggaagcaacgatgacagctgagcatacctatcttgatgatgggctacggagattattatctcctctcttggcttggacttagtacgcggcaggcctcgttgccgttgggctaggaccaggtagagatggagacctgcagcccgaatcacatttgtcacatctcattgggttaggttttaattacagattcccgaagcccaatacgaacaaatcgatgtcaaaagattcttttggctacttgtgaatctgcaggttcaaaaccctcactcttcgtggcgggaaacctgactcaaacacaacgtcgggataaacatacctgcacgtccccagcctcacaatttggagtgccgattctatgattgatgcccaatccgaacgcgttgatgctctcaacatccgcaagatctccatgaagatcatctttgaacctggctctacttcccgtccctgaccactggatgacaccaaatgatgagtcgaaaggacaaatcaccgataaaaaaatctttccctgcccaagttcaacagctctcctgaaccagccctgtataacagtatgctaaatgcgtcctgtcttgagtgtcatcctagtttcggcatgcttccgcggctcaccctagctcttagtggattattgtgcaggagcaaaccggtcaggtgatgaggaatgccatgtgcatttcatatcatacagcaaaccatttgtgagccagtaccaaatattccggtcaatgacttttagaatgagggtatttcagtattgacgcgcgccaattgagttgcaacgatggacccgtcagtctgcgtcgacctgagcaagtatggggacgactacatccatgcgaaaaggacaagaccaggggggtttacatcaggcattgtaaattatttcgctcaagataggaagacgaccaacactggagatgcccgacaagggtcaggatgtctttctgggaaaaaaagcaaatatccctctacctcctgtcttctattgattgattgtgtgttacttaccctagaatcctagctcacttcattctcttgtccagccctatgaaccttgataccgacttcaacacctctttcctccagacaagatattcttttttaatccaagttaagatatatcaaccttcatataaaaaggttccatcaagatgatgccttgccttcagaaaggtagcgctaccacctttccgctcgttcttttcatcttacctaggtgggattctggttaggtcggtggcggtgttcacacgcctgtgttccccatcctcttgtcttcttccctaaaggaattcctagcttgtagatgcgcatacatccactagctatactccgtatataggtaggtaaccagcaattcggacacatggcacactgctgtcgtagaagctacagacccagtatttcttagtggataaaaacagccacagaatcaaaagcaaatgatttattttccgagattttatatacacataattttccactgttaagttactagtttcgaatccagtgccgatagttttgatgtgccagttcaaagtgaatgtggatctagaagacgcaaccccaactcataacttttttatggagccttggcagcagcaccgagcttcgccttgcatccacgcctcatccaatcgcaacaccattccaacggccaaatcgatgctgggttcttcttagcctaagagggacaggaagcaatcgaactaaaccttaccccgctccaatctatccattcccgacaatggcatctcgtcaatccctgcgcgccttccaagccattcggccctcagtgcccacagcctcctaccgacctcgaacatggcaagcagtacgattctactccgaggccgctgccagtgagaccccggcgagcgcgccgtatctccagcatctcaagaccgatctcaagaccgccatgcgagccaaggacgcccctcgtctcgccgttctgcgagccatcctctccgcgaacctcaatgcctccaagacaaagactcccattagaaccgacccccagctcgtgattcagattatgaagatgaagcgttccatcgaggagaccgccgcagaagccaagaaggtcggtcgggaagatttagctgagaaggagctcgagcaggccaagctcatggaggaatacatcgtcaagagcaagcttgaggtcctgggagaggagcagctccgtccaatgatcaaggagcaaatcgaattgtccatcgcggagggcgctcagaccaagaccctcatgccagatgtgatcaagcggatcaaggctgcgaccgaagacaaggttgtggagagcaaaatcctggccccgttggtcaaagaactcatcaatgagaggaacaagtaaaaccagaggtaaagttcgagatgagagagtctccagatgtattaaaatgtaaagtattatgtacaacactcagctttagatgagatgatgcaatgcccagatataacctctccaagtgtgccatatcttgcatttccatatataatctaatttgggtgggcaggtcttttttaagataagaaaccgatggagattcaaattattaattcctcataagcatccaactgcgagatgagttgggtgattcgtatccctccggatacggagatgcctattaaccccacacacagatatcatactgagtcatcgagatggtataagtaacttttttctcgctcagttttctctttctaaacctcgtggaacattagtctggtccaatcttgacatcaactacgttcattatgtcgcgaatcaacatcagctcaggctctgcctttgaagccgagattggctattcccgcgccgttgtcgtcgatggctgggtgatggtctctggcacaaccgggtaaaaagaaatgggaaaccgaacccctctcgccaatcaactgacataatgcgtgtagatatgactaccagaccggaaagatatccgccaatgccgaggagcaggccgagcaaactctcgtcaacattgccaaggcccttgaggaggccggatcgtccatgtctgaggttgtgcgtgtgcaatacgttcttccagatcgcgaggatttccccaagacatggccagtattgaagaagtggtttggggacgtccgtccggcggccatgatgattgaatcaaagttgatgaaggaggaaatgaagattgagatcgaagtgacagccaaaaaggggtgtgcaaaacagtaggggctcgtacaaccaagcaaggctaatcaagccataacaagagaaaatcttcagagtttaagcaaggatactgctgccccagcgatgagggcacttcccatggtaaccaagctcgatgtcgatagtagtgacatgccactaatcccatgtccggaggtacagcccccagccagtctagatccaaccgccatcaaaacaccccccagagttgccagcagaggtgttggctcccaggtagacgttccgcccagctcaggtaccaaatatgccatgccaaatgcccctgtgacaagcccggtgccgaaaacgatcgagccatgcccaggcttcttggtgctgtctgccccgttcacaagccaccagaagatatttccagcttcctcgtagcacccagagatacccatcatggattttcgcgaaagcacagaaaagagctgtgcggcaccgagaagcaggccaccaacgacacctgagaccttggactgggttgtgttggcagagaaaacatttgtcgctaccacggtacctgcgcagacgagttcgaatatggccaacccaataggtttggatactcctacttggtcattcaaggtggtcacgccaccctgaacaacgatattctgcctgcgattccttactgcggtgctgatgggacctgcccataaagcgcctcctaaaattgctccctgaagggcgaagaggccgctacgaattccagccgcgacctgcacgagcaatgtttccggcgctgatccagacagcgccatgccggcaccgagaagtgctcctccaatagcattgccatcaaaccttccaaagaacccgaggggtgagggtcctctaggctgaagcctcacaaaccccaaacgctcaacggcgctatatatgatgctgtatcaagattagctgaatccgacacaagttcgttcttagggtctctaacgcgctgcttgctgttgctgtgagaaaggcttgcaagaattgatggttctcaaacttcaactgtgaagcaaccactgacgggtgatggaggccagcagcaaagatgccagctccaaaggcggcgccagacaggaacgtagccatggctaattaggtactccaattcttggtttcttggctagtttgaattgttcttttggaaatggcgataaattaggtttcctttagggaagagtatcgcgactcatttgattcgtaatgtcgctcatgtgggaagatggggctagtgcgcgctcaccagggaagagtctccccggtttcaccacaacctttccaggattcagaatatgcataatcaatgaaatatttgatgcctatctcaattgattatctgaaaacataaacagaaattctaccaggacatcaatcaatttgccactatcatatcgagatgttaataagtcgatggtatagggtagtaaaagatacctggaggagcatgcaaggttgcggtaagtcgcaatggaagggagaaattggctgagctacctctacgtggtaaatttctaaaagaaataggatttcttacacttttgaaactcaagttccggataagaggaaaacttagatggcatatgagttccaattaactgcctcggttgatgaatcgactgccgagggcggggaatacttgctagctaatcatcgagctacccgacaacacagtacatggatgtaatgcagccaacctacttggtatttagcttgtgtgatctctaagcaacttacttcctctttctttatcaaattattgacggatagtacagctacccgatatacctcaatttttttcaatcttcaatcgagaaccgctgactgtatttcggcttgggtattgattaaccatgtctcgagtgcttcatataaaacaagttgctgggaagcccggtgaagtctattacccgtatgtccgcgtgccctgatagtgttgaactctcatgacttttcatttcctaacatttcataggcttcagctgcgggaagaccctcgcccaaaacctgggaacggcgaggttctggtacaaatatcagccgcggccctcaaccaccgtgacctattcatccgccagcacctgtatcctgccatttcattcgacaaccccatgcttgctgatggttatggaaccgtcgtcgagcttggaagcaacgtcgctcagcccgagctcctcaacaaaagcgtgctgctgacccccatgcggggttgggagtcagacccagacggtcctgacggcgggcgcagctacgcagttattggctccagccggatcacaccagccggcaccgcccaggactacgtcgtcgtcagcgagaaagatgtggtggtggcgcccgaccacctctcggcagtcgagggtgccgctctgccgctggtagggttgacaggatggcgcgcgctggtcaccaagacgaacgccgcagcacccgggaagaatatcctcatcacagggatcggtggcggagtagccctccagactctgcagtttggagtcgcgtttggcgcgaatgtatttgtcacctctggtgacccagacaagatcgaaaaggcgaagcagctaggcgccaagggtggcatcatctataaggagccgaaatgggaggccagcttgcgggaactccttcccaaggataggccgtttattgacgccataattgacggcgcaggaggcgatattgtggccaaggcggtcaagcttctcaagcctggcggtgtcatctcccagtatggcatgaccgtgggacccaagatggattggtctatgctcggagtgttgaataatatcgagctcaagggttcgacaatggggtcgactagggagttcaaggacatggtcacgtttgtttccaagcacaagattcgcccagtcatcagtcgaagcgtgaaaggactcgataacctcgaggctatcgatggattgttttcggaaatgaaggctggttcccaatttggcaagctcgtcatcgagatcaatggtaccgaatcgtcaaagttatgagaggaacaaccggacgggtatcccgggaggttagagcgctatagattgggttcaataaggagatatatgtctaggaattcacaactttccctgaaactggctctgatttagaaatcgagtcagcggtattgggtactaattagtttgttcaagagaaatgtctttatgctgcctaatgcctccataccttgaatacgccgagacgaaggaaaataaatacaggttcgttttgctttatttattcggaagacttcttccgcttcttcttgggacggtcaccttcctctggtggaacaaattcagcctctcgctcctttgctctgtccttcttcttctccttctgcttctctttgcggtcctcctgaactgctctctccttggcacccttgctcaagaagtactcgccagactcgatctgcatgtcaaccttgctcttctcaggagcgggtgggaacggcgtgtatgtcttcttggccttgtcggtaaccttgtgagggacacgtctgtggctcagtgacttcttcttgaagttgggcaagaaacggtcccagctctcattggcgagctcagggtcctttgcaagctccctcttaatcataagctccttgatgtaataaattgggtggatgttggccatgcagtcctccactaccctgcgcacttccttgaggcccttgtacgggcccattgccgatactgtgttgccgtggacgaggatgtaggtctgggtgagaagctcaagagccttgagggtagatccattagggcccaggattctttgacgtcgcttcacgaagcggtctttgttgttgacaaggttgcggatcttgatgacatcgcaggcaacaccatcctcgaggattttcagggcttgcggggctgggacactgcgcgcaagcagcttgatcaggtcgcgggcattgaggatagcagcagggtcatatgtttttcgggtggtcttgacggtcatggaaccctctacgagatcgagggtgcaagcgatgccatacttctccaatgcctttgttactagaggccaggcctccttcaggtagacttcgcggtacttggggaagagggtagcgaacgatgactcctcagcgaatgatcccccagcattgtcctcagccttgaaagcatcgatcttccacttgtcgatatcgtccgtatcccacggcttttccttcttatgggtcgaaggcattgcggtcgcgtgtgattgattagtccgagttgtgatcgcttaatgaatacaatgagcggttatccaaaggcagtcgacgtagcgagttggcctctcccttgtgacactgggcgagggtaaaagttgtggtatttcgaatagaaaatacaactgcactggtaggatatgatgctagagaacgatgcaggtccaaatttttttgttatcgaggaaacttgaggtggggctggcagcagatagtggagactgcaaagacccctgccgtggattgatcaatcgcgacaagctccaaaatcttcaattgcaggagactccagctcgacctctacgcccgccttgccccatatcaccacacaaccgccacaatgtcgaaaggacgaggaaccggcgctgtcgaccagatcgtgaagctcatcgttggagccggacaggccagtccgagtcccccagtcggtcctgcgcttggtagtaaaggtgtcaagtccatggacttttgcaaggtaagcctgcttcataactgtgcttggagccattgtttgaagcatagactcgatgtgtattgacaaaaaacccttttcctacaggaattcaatgctagaactgcacacatcgtcgtcggcactcctatgccttgccgtgtcactgtccgtcctgaccgatcatttgtcttcgacctgcgaacgccccagacatcatggcttttgaaaaacgccgccaatgcacccgtgggaaagaaggggaggaagggagcacaaaaacctggccacgagtcgatcggaactgtgagcctgaagcacatttatgaaatcgcaaagattaagcagtctgaacttcgattgtccggattatcactggaaggactctgccgatcaatcattttccagtgcaaatcgatgggaatagatgttgtggcttaaatataggactgaatggatatctggcgttgggtttgcggtcgtcggcatgtattatttagtgtacaacagagcgccgggactggagtgactgaccctttgtatatgatcctcattaaacgatgacttatggaaatgtgcaagcgacataatgggacagtttagtgaaccatatgcctgatagctaacgtttttacctgttgcatatgactgcggccctactagatctcctgcatacattgttggcatgtatttcctccaatttttgtcgtctataatgctgatggataacactgctcttgacgtaatatgcgtcgaacttatacagagcctataaacaacgcctagaatgaatgagggtgcatggctttagttgctgcgatcgtaactaaaaccacaatggcaactcaaacgtgccttgagcgacattagtaggactgagggaaggttgcggatgtctttgactcttgaagtccaatataaccgtacttagggtttgagaatatcctggatgatcaacaatttcgtttcgtatctgtcgcgagcaaccaggtgaaaagtcttctagaatgatgtaagtcatagcacgcagtggtatttctaagttggagggtattgatgatgccctactgcgaaactctgaagctacgtccaatgctttcaattttatataaaaggatacgaaacccaagaaaaaggagaaaaaggatggggaacttcttcatgatagtacattttctgacactgcctaggtagtgaatcaagctacgaagcgactgcaaataggtagccggaaaactgttattactgaatctgtgcaggcaactaccaagtgccaaggaacaggtagaacttaccattcctgctttttccttttgttcacacccgacgacatcaatgcgcaacatgggcaccttgacgccattctgttttgatatttgggttgaatcaatgataatgagaattgtttgtatggactcacgactcgtccgaatggcccgatggctctctgcggcggtccgtgtttgcggatgcagccttcttcggcttgaatgagaccctgcgaccagcgaccggtccccgctaagaacccgatgagcggagcgcgctgcgaaatcgtattggcgaagcctacctaccaagtgacgcggacaaggagctacttacactacccaggtaggcatgcaaccctgaaggcctcaatgacttcattgtagctatgcgcattactttgacgagttctaatactatcgttcctcatataccctactccaaaaaatgagcataatatttgcgcccaatatagacacccacacggatagttggggtatttctggaagttacggaaaggaagacatgctacaggagatgatggcatgctgtagtgcccaatccatgtcctactacggcgaggagccgatggaacttctgacgggacctcgcctcgggacgaaccactaccgcacgttcataagcgctccgcggaaaaatcggtactttcgatcctctttgaggtatttggtgttttcgcaatattgattacggtaatgctatgtgccgtgatgcctctttgccggtagtaccgagctataccttggaagcagcttgatgtaatagttggcgattaatcaatccgccgtgctagcaaggttgtttaaggtttgccgcgcaagaggcatcggtgcccttggtttggcctgatcggctcggctggtcttgccgtgcccgaaacagccagccaccagcaaaggtcgagaaaattctgcccgttgttttgcccccaacattagtactaacctagaaggtttctaacgcttttcagaacgggacccgcggtcagcagaagagtcacttctttgccgggttcgggcgcggagcttactgttcgcatgtgagaatggagctcaacgataacgcacatgcgctgtaagatgaatgctgctggtccacttatactcatgatgtctacagattggctggtgcgaagatactgtgactctgcagcccaatcattgcctatcagtgatgacggatggatgacggggatcccccgggaggatctcttaataaacatggggggtgcatgagttggggtaggatacctacaagtggtagccagagactcaaagagggccgccttaccgggctatcacggccagctggttggctctccaaatgtcacctcacctgctggaggtgtgagtcttggagccaggccacacatagactgcccgttcgggcgccaacagccagaacagcactttcttcgcatcttcacgacggatggagagtgagtgatgcttgcgggtgggaccgaggtggtgcaagccccactaacactgacgagtaccttctgttccagcttttcccaatccccagtaattgcctgttgcccgcagtacttacaggcaggaaaagttgccatccatcccaccaacaccatcatccggcactcttatcctccagctttgtccgctgtcgccgctcgtttctttctttctctcccccccccccatcttccccccttcccaacaaatctgccagcattgggccaaggctcccctcgacaacatggccttagcccagtcagaccaagaacagcagaaggacgcctctggtacgttgctatcttcccgacccttccgaatcaatttgacccaaatgccccaccatgattgtcgcaacttctcttgcgatatccgcaccttgacatcttgtagtatcgtgttgctcaccaggccttttgaatagtccccgaggcgcccaaggaaaacgaccagtcattgagcgtcaatgcgccgtcccaaaatgacgtgcccgctgttcgcttctcctcggcggtcgaggagattaacccaggcccaacaccgttaacgagccctccggaggaaccagcacagagtcaggaacaggaacctcagccgtcagactctgtctcagccgaagatttgaaagatgttacacgatcgctacaaacccttccgttacaggaacgccgcatcaatacctatcacttcgaaccgttttctttaccaccctcaagagtacgtctgccccaacaacccaaggcacaagggtcttcaatgtccgtgccatcatgccaagtttttctttttcgcaagcccaatttctcgggtcagcgctaccttttgtatcctccttttcttagcatgtccacaacgataaagcgtcctgtttcttgcgcctgtatttctttcgattgactcgtcattgtaggttccatcaagagacgaagactcacccggccactcgacgcttcctacgccttcatccgcacagttcccccaatcgcctcatggcagcccaaggctgtcagcaatggcatcaccgccgctcactccagcaggatcagctctttccccggagaaggagaagatgaagccatctcttcaggttgcaccagtcgacgattatcagtcaatcaccccccaaccctcatcatcaaacgaaaaatccccttcgctgggccaacgagtacctctcgcacaccgacctgcatcttcagaccagatttttaagcgatctgcctccgccgaggaaagacaccaggaactcacgtcacaccgaagaggtcttatgggtaggcccgcaggatctgttcccgtgtcccgagaatcgagcccttcgcgcatttcagcctccaacttttattcgaaaccgatgactcctggcggagatgcgaatgatccgtatgccaagggccgacggcctcctcagcaatctgggcgacactcgattgaccctcgcttcattttcacgaagaagaagaaacagcatgggccatctccaagctcctctaagatgagcctgacggaaaagcgatcgtctggtatttttggaaagagtacgagcgacgacactgccagcgaacggggtgtgcccaccactcaacaccatggtcatggtcaccatcagcacggaggccatggctcaatggcagatctaaagcggttttttaagaaaggaggcagccataaaaaacgggagtccaaacaagtggccacgccgtactcgtctacaaacggcctaaacacgcccccgggtgcccggtcatctacacagcttccgtttggagatgatcatgggctgtcctccaagtacggtaagatcggcaaggtgttaggttccggggctggtgggtctgtgaggttgatgaaacgtaaggatgatggtaccgtgttcgccgtcaaggagttccgtgctagacatacttatgagagcgagaaggagtataacaagaaggtgacggcggagttctgtgtggggtcaactctgcaccatggcaatatcattgaaactcttgacatattgcacgagaagggacggtggtacgaggtcatggaatatgcgccgtttgaccttttcgcgattgtcatgacagggaagatgtcacgcgaggaaatcacttgctgctttttacagatcctcaatggtctcacataccttcatagtttgggcctggctcatcgcgatctcaaactggacaatgtggttgtcagtgacaaagggatcatgaaaatcatcgactttggtagcgcccatgtcttcaaatatccttttgaaactgacgcggttccagctaaaggtatgccacgttccccacgctggacaagaagtgtgcagaactaactgctctctaggtattgttggctctgatccataccttgcgccggaggtgtatgaatctaaggaatatgatgcacctccagttgacatttggtcgcttgccatcatcttctgttgcatgactctccggcgcttcccatggaagttgcctcgaatgacagataattcctttaaattatttgcatctgagccaactcctgatcacgaccctgcggcattggtctataaatctaagcgatcggcggagctgcttatgatgtcgcccaaacctggtgaccacgagagccagcactactctgaccagcaccaccatgattctcattcgcaccatcacaagcgcggagagtctactgcaactaaggctccagagcctgaaaaggtcgaaaagactgaaaagccggaaaagaccgataatgctgaaccggcggagaattctgaaaagactgagaagagcgcgaagccagaaaagactgagaaggcagagacctcctcatcgcagtctcagcaaccgccgggcgagaagaaggaggtcataagaggcccgtggaggattctgcgcttgctccctagagaaagccggcatattatttggagaatgctcgaaatggacccaaagaaaagagctaccatggatgaaattttggccgaaccctgggtcgcagacactatcatttgccagcagctggacagcggagaggttatccctgcttgcgaccacgaacatgtgctggagccgcccagcgcccagccacagcccaagccatagttccctgcacatatatgatgttgtccgccttgtgtggcggagggaaataattgtaggatattcagcgacgggagtatcatactgggaatagtaccctttggaaacgatttgatgcccccttttcccttttcttttggtttattgtttgggttacaacggcagaatgggatgacagacagcagcgggctcgtgtcgcgcaatattgcctagataggtgcagacattcattctcctcagggagtcattacacaacaggtggtttcagagaaaacagtatataggggcatgaatagacgcattagctttacgcgtaccttgtatcatcatccactggaccacaagggtatcaactcgaagttggaagtggagtgcagtgtgaaccgcgggaccaaatggctggttagagaagcacgccgagagagagggattcctattcagaagcagtgaggattactgtgccctgtgttcgcccgtctgaggtttttgcactttggatgatcgaattccctcacacgagtacagggattaatcaatggtttcgtgtatgcaaaaggcgaaattggaggatagaatctgagacatagctctggcaaggagtagaggctgattacccgattcgtaagctggattggaagtgatgtgtgtggttgatcctgctgatctgcctaggccgaacccgaacagcagcttcctgctgagacgctatgccggcctaaaaggtatcatccaccaagaaagacaaccataggcaagaaaaaaggggtttctatggaatggatggataccgttatggtttcttggacctttgacttgttttaaagaccctcttgaggagtgcgcaacaccgacggctgaataaggtggggatccatatccgatctgatcgtggggaaaagttggtgataccggagccggggaaatccgatcccgaggtggtgggaaaaaaaaattgcctgggctttctggaagctgttggaatagagctccactgccgaatagcttcagtcaaattcctcctccttcttccgaacttcgctcctccgcatcagcatcaatcccgtaactcgttacaccacacaaccaccatcacaatggtacgtgccaactactcaaccattcctaccaattcgtccctccgcccgggagccggtcggcgagtttcccaggtatcgccggcgggcgtatcctcggcaatcttttgcttcacactctacgacgacaaacgacgtctggaaatcggaatagactaacacggggaattgatacaggccacctccatccgatccatccgcgccctcgcccccctcctggaccgcgtcctggtccagcgcgtcaaggccgagaccaagaccgccagcggcatcttcctgcccgagtccagcgtcgagaagctcaacgaggccaaggtcctggccgtcggccccggcctcctcgacaagaagggcaaccgcctgcccatgggcgtcgctgtcggcgatcgtgtcctcatcccccaggtaaatgccacacaccgatctttcgggaatctatatgcacagcaaaggaggggaagcggagcatggcttttctgacagtttcttgttcccctctccccatggatgctaccgattggatgtctatgggacgttgtactaatggggggctgtatagttcggtggttctcccgttaaggccggtgaggaggagtaccagctcttccgtgacagcgagtaagtttgtttccgcaccggtgtattaccctggcacttgtatatacgggcatggggggcacaggctaaccaagtgtttctgcaggattctggccaagatcaacgaataaatacgataccctaccgccccgtgtaccataatgtaccatctagtatttcaggagaataaaaaaaaaaaagctaaagacatgacgacgtggtggtcccattttcgttgcccaggctggtgtgtgtgtaatgtaaggttcatgggccatgtacaaggagggaagcgtctcgcttggagaatcactggtctatgtgtatagaggaaaacctgctgttacgaaatctccactcatgtctggtcacaattccagttactgccacctcgctctgttcgtccggtccatgacgtgaatcagcgcatcctttcgggtataacgacatgtagtgtagtgcattgggacgcccccttgttttacgtggtgatcaacgggccactaatcccaggatacgtggtggtgcttcctccctcgggagaagaagcatagcacgagtcgggttgcgtcttgtctttttcccatgtcttggctgcattcgcatggacctccgacgtgctattaagctcctgcttaccagcaaatcttgctccaggccaatcggtcaattgttagcgccgtcgttgtgcaggtggttatgcaaggcaccagaaccgccgcaccaagtggaagtgcccttttctttttcttgcgctttgtgctccctctgcgttttcgtccagccagccccgtctgccaatcgcggaagcgccctgaaatcgttggttgcgcagcctagattaatcaagtgtctccgtgggcgttttgccatagcccccccttctcgccatcctagacacgatcattgacatgggcaacggttcaccatggggcgatccgtggccaggacattccggaaaaggtcagacgtgtcggccggatgggcaggcccctctgtgggtgatgtaggtgaatgggcattgccggacgagaagcagggtatcgccaagaggatcaggaaattcgtgacactggcgctgggccgcttcagcgccaaattgttcagctaaggggtaaaagcgctgtgcttatgttccgaacaataagcttgttggcctgggctggggccgaacagtcgcaccactgcaggtcgccgcccgccaagagtgcttggaactgccgaagcgcgatcctcttgcgtttcatgtgctctcaccaaggctcctctccggggtccgccattgggcttccgtcccaacctgcatcttggtgcgagtctgttcatttcaaaaagccttggaagggcagaagccactgttttatcgtgctggggatcccttgtccgcgggttgttctcatgcacatgcctttttttaatttcctcgtggcgatcgtctcaactcccgccgtagggccatggcggttggatctataagatggccatggcgaccaccccctcgtgtcttccttgtcttgacccttctgttcgcgggcaacttcaccactttcttccggactgtccttgtctgagtcttttttcattcattcattcttgtcttttgtcaaacactccttcaactattcactccttgttgatcaaagaacttgacgttctctcatctcgccgagtttctcattcacttacagcttgaagctgctgcttgttataccaaaccctgcctgagctggtctggcttcttgaacctccaaactcaacaacaacaacaactccaatccggaaagaaagtgttctcgaacaacatccaccatgaagtacttcttcactgccctgagcttggcctccgtggcttctgcccacaccttgttcagcaaccttttcatcgacaacaagagccagggtgatggcacttgtgtgcgaactccctcggacgcctccaagtccaacagccccatctacccactcaccggaccggagatggcatgtggtaagtctcgttccgtagatccccaactttgacagcttctgatcgagtgacaaaacaggccgcgagggtacccagacccccgtcaagtacatctgccccgccaagggctcatctacactcacctttgactttcgtgagtctcccaactattcaagggccggtgccatcgacggcggccacaagggtccctgttcggtctatgtcaagaaggtcaacaacatcttcaccgattctgccgccggggccggttggttcaagatctgggaagatggttacaacgccgacaccaagaagtggtgcaccgagaccctgaatgacaacgacggcttcctctccgtgaagctcccctctgctctgccctctggctactacctcatccgccccgagctcatcgccctgcacgcggctactcagggcgaccctcagttctaccacggctgcgcccaggtcttcatcgagaatggtcccgccggcgacttgagcattcccgacgagtactctgtcagcatccctggctacgtcgacgcaaagcaccccggcctcacctttaacctgtacgacggaacctcgcccaccacctaccagatccccggccccaaggtctactaccccgagtcgagctcgagcaatgatgtcagcaagacccaggacgccggaaagatccccgacgactgcatcctcaagagcgccaactggtgcgcaaagcccgtcagcacagtcgcaactgacaacaagagctgctgggcagccgcccaggaatgctgggaccagagcaaggtctgctgggactcggcggccgttgttggatacgagaactgcaacgtctggggcaactattgcgaatctctcggccagagatgtgagaacaagaactatgatggcaccccagccttcagcggaaaggaggtcgctccccacgtccccagcagcgtccctgccccgtacaaccagccgaggggaactgagcccggaaatggcggctcttcgtctgccgcctcatcatcgtccactgccgctgctgccacctccagtgctgctgccgtcaccacttctgctgccgccgctactacctctgctcctgcggctacgtccacagctgctcctgttcagtcttcctctgcccagtctgtctcgaccaaggtcgaggacaagcaggcatcttcctctgctctccccagcactacgctgaagaagtgcgtatccaaggtcaagaccgtctggcagaccgtcacggtcaccgcggctcccgcgagacgctaggacgccttgcggtttcgcttcgatgccccttgagtatctgggtcctcatgctgcgatcctgctgcctgtcaggaatctggtagcctggatgtgagcctgtagatggaatgttcggaagggaagcaggtagttagggtccttgaatctcatagggagataccatttgtctgtatgtaggaaaatttatgaacgaattcatcatttgatcgatcatctgtgccagttcagcattgttgcaagccttgttgacgaaacacaaggcaatgcccaagtgagcgtgttagactttggcctccgctagccagaatagcctaaatctgcgagatttcatgaaccgagtccggcaagagaccgagtcagaacaggcagagaatggctggctggctccatgtgacttccttcctggcctgtagaattcgcctccgcttccatgttgggacgaggatgacgttaattgagaccagccacacctggtggttatcccatgagcttgttggggtgagatagtccaggtacttgtcgggtggcgggatgcatgtacatgggcgtaccgtagccaccagccatctgcccaggccggaaaaaacggtttcaggcacctgctaacttatcatatcaggactaagagataagtacaaatgcaatgatttattgcatggccattagagattggatgcaatgaacggccgcggtgccgtaatttagagatgccagctctactgattaggcgtttcagaatatgcgagtgatggactcgaaagggaaaaactgggctttcataggacgaattaatttctcaagtagagtctgaaatttactgaccgagtatcagtattgttatcttgtctctgaacaagcactgtcggagaggtgcttgaacagaatctcacgcatagatgatcatttaggagcaaggctgctatttataatgcccaagcttacatcgaatgctgtcacttgatgggcaaacagacatctcagttggtaccaccgagaaaataccaaatagatgtaatagggtgttggaaaccgacggaaagcagcgataaccgtgttcttattgagcccagtgggataggtatataggtagtgctattgaaccagagtagagtatttcgtggctggtagatgcatcatgaacaaggtgaagattaagttcacaacggcattggaatctagggctgatagatgatagatatgaaaaaggcaatgcctatcagagactcgtcataaataaacgagattgtgtcgtccaagccacgcggagcacatgcacacactgacagcggtggatccctggaggccagcagtcgtccttgttgtaacggacgtgagagtgccctgtgcggatcgccacggggcacgaccagcactggatcagccccgtgcacctttatcaaattagcagccaccctaagttttagggacttgtcgccagcaatgggacttgccgctacttgttgcctgccaggaccaggtactactcgagtagtgctgccttggtgcctccgtgctgccttcctgactcttgcctccaacccattcgaacccaacccactcaccggctcccacgtccaccgcccaccgtacatacagttaggtgacctcaaacgtccgacctcccccagcccacctcgcctaagtcgcaccttgtcttccaactttctcgaatcttttctctccgccgacgctgcgagacctcgaaacgactgcggcatctcatcatccagcatattgcgacacttagtatcttatcgtccgccgactcccctcgcccaaaatgtcgagtaatcgtaactacgatttcttggtacgcccagcccgttccatctgtcccaaaccacccatccattccccgttccaacgccgcatcgctgctccccctcggctctgttgcgagcatttcttgcccacatgccacaccagaaccccctccgaaaccatcgcgatcagcccatttctcgcttcctaggcctcttttgatgacggttgacaatactgactctcccgcgcgccatgcgctctgcccctattctagatcaagctgctcctcattggcgactccggcgttggcaagtcatgctgcctgctacgcttcagcgaggactcgttcaccccttctttcatcaccacgatcggaatcgattttaagattaggacgattgagctcgatggcaagcgcgtcaagctgcagatttgggacacggctggccaggaacggtttcgcaccatcaccactgcctactaccgcggcgctatgggcattctgttagtatacgatgtcaccgatgaacgatctttcaacagtatgtctctctgtgcaattccaacacctctacatattccacgcttccccgcctccatctgtggtcccacgaacaggacagattcggctttcgcaacatccacacgatacacaatgacaacatgtgaataatttggcaggtcatgctaacgggaaatttctcttcttttagacatccgcacctggttccagaacgtagaacagcacgccaccgaaggtgtcaacaagatcctgatcggcaacaagtgtgactgggaggagaagcgagtcatcagcacagaaaaaggccaggctctcgccgacgaacttggcatcccattcctcgaagtctcggccaagagcaacatcaacattgacaaggcattctacagcctcgctgccgatatcaagaagcgtctcgtagacaacactaagaatgagcaaggtggcggccccggtgtcaacgtgggcgacaaatcgaacgcaggcggcagcaagtgctgctagatttatgatgtcaacaagttttgaagggggatttttttttttttacgtggaacggatgagatgcatgagagcgacaagctgaaggcaatcaatcactgagcatatacacgcggatggtctccagtccattcgagagctagagccgaggggacgacggagcaaagatccatcattttcatgtgtaggattcgagctcgctaaacggagagagatatccttcaagcgagcgcgtgtgttgttgatacctggttttttttgggaggtgacggcgaggcgccagcgtcgcgggcggcatgggagggcgacaccaagatgaggcgcgcgggcaaggtcatgtcttaatactgtgtctcccgcccccagctggtctctgttcctacttctttagagagcaaataaggtccggagtttctgggttttgatctgggactaatatacattcctacaatatgtggtttctcagaatgattcgagtaggtgggctctatatcagtgatgcagcactgctctgggtctcgcgtgcatgtctatctatgtgcttataatatatacaaatatacgaatatacaggatggatgatagtacaaccccggtccagtctctcccatgatttaccagttgatgaaggagacgttgagaaggtacggcttgcgaaggtcgtcatcaggcagctcaagttgccgctggttccagccccgttggaacctcctcgcctcccactcgttgggaaacgccaggacgaagcggcctctcagcgagtccaacacataactctccagcttcgacgtcgtttccgacgatgtctgagccgtggaggcgtccaggagcgagaccggaaacggcgtcttccaccgcgaatctcgcttgtcgccgtccctcagaatcgcatcgtgcagatcctccgccgcgagatcgggagggtcggcgtggagcaggacggcggcgggtctgggcccaaagtccttggtgatgttgtcgcccaggtgcttctcccagctcttctgcgacgtcctcgcgcgggagacgagcaggtcctgcgagggtgggaggagggagtacgactccagctcctggtccgggtcgacgccgccgccgccgccgggagcctcgaggtgcttggggatggtggccgtccacaggccgttctggctcgcgctcttgagcctggccagctggtggaggcggccgacgtggtcgtggtaggcggcggcggcctcggaggtgatgaaggagacgtggtaggtgcccgtcggctcgagtgtcagcctctcgcggcgttgctggactgtgtccctaaaagttagagagttgttgcgtggggttgacgggtctttcacctgccctttttgatggtgtttccccaggcagacaggctctgggactcgggggagaggcggtagaagtcgctggcgacgaggttcttgctcaggcccgtgaagacgagcatgttcttgtgcctgtcgaccggtctacttatctcttgttggctgggtcgcaaggagcgggtgttggctcccggagccgtcgcttgctcggtggaagaaggggtgcggcgtctcagccctggccattgaacggcctgcttctcctgctgttcttcgtctcggcgttgcaggccatcgggcaggtttggagggggagcggagccggaggatatgaagcgtctatgagggttggcgcattggcggatcgacgctgtcgtcgcttggctgccggaccattttgggcgtatcatgcgggcggtgagagggggacgagagcaatcatcgaggctggatggcgttctgcccgcgtcgtctcgctgttgaggaagggcaagaatcgcagggatgttgtgtgggttgttggtggtagctaaaatctggacggagccgcacagagagcaagagtgtctttcatcaccctcagacatgcattcaccatcacgctagtcgccagcggccggaaaattctgaggatggcattggacgttatagcttaagatcgagacacttattctaaatataatctttcctcatatttccttgatcacgagtggaaaaccgtacatcgagatgtagagctggagtggagggcagcgcccactgacttgctcacttacaaaatttctgaactactgagagaatcgaccacaagaatctccattttccatttcttcccatccactccaggctattccccctcactgcaccaccaaatagatagaggtacgtctctctcccatagaaaattgaagcaagaaaatttttgtagatttgaatcatttctctaactttccgccgtagggtcagccgaggacggagagcaatggtcaagaagtccatcgacgccaaggtgcgtccgctttccaacacaagcctcgagaaagccagccttctcggcgcagcccgcctctatgtgagcaaggactcgctcatctcgctcaccgggaacctggacaatgggaaactatgcattgtcgagaggttggagacggaggagcctcttagacgagaggctgctctttgggtactgccagagaagaatctcagtccaaacgttgtgatgatgactcgagcattccaagatgctactggcttcaagattggagaccaggttcgcatatctctggccagtgacactgcaacgccggttatcgaggaggttgttgtgcaggaggcgggcgatccaggacaggatgatggttccgaggcctaccatccccctggctgggagttttcgatcagtatttcgctcggtaagccagttgccgctcaggcttgctcttcgttctttcagaaattctgttaaactgacttaattccagatcgtgctgagttcattttccctggcatggtcctggagggagttaccatcaacaagctacgccggtcgttcaaggttctatctgtgaactctcaaaaggaaaacctgggcaaattcgttctcagcaacagcaatgtacgacttctcgcacccggagactcggaagacacgggcgcggctgctctcgctactgaacccgcaggcgatctggtcgtcagccaagtcccaggtctggcgagacaagtcaaggttatcaatgccttcctgaagggatttggacgcccgttctgggtgaaggatgagcgcgaatctagtgccttcgtcatccacggtggccacggcacaggcaagacctttatcatgcagcgcatcgccgacactaactgggggaaagttcactggatcaagccctcggacaaactggttgccatcaaagatactttcaagcaggcccagacgcagcagccgagtattgtgctgatagatgccctcgaggaactcatttcaaaggaccggcaaaacagggaggccgtcgtcgaggcaatcgccgaggaactggatgctctttcggctaccgccaaggcacagaatgcgctcccccgggtggtggttattgcttcctgtctcgactacatgaccgacgtcccgccaaagctgcagaagaggagtcgtttccgagagaacattgctctccctatcccgagagccacggagcgtctggagattctcaatttcttcgacccccctatccgccccgaagacaaggagtcatccctatccagcctggctcagaagacacacgcgtacaacggagacgacctggccaaccttgtcctcaatgcaaagaagattctcggtaaccgacttgacgatgctggtgttgaccctgagaatgccgagccccagtacctcactcgcgacgatatggaacaggctctacgcatcacacgcccgacagccatgcatgatatcaacctcaagcctcccaccattcactggcaagatgttggtggtcaggagaatctcaagaaggtcctaacccgcatgataaagaacaccaaggtaagctctctatcccacatctctgtcccaatccccttctcgctcgtccctaacctcgtctgccaaaaagaacaccaatcccgcgagccggcacgtcctccgccacccacccaaaggccttctcctctacggtccccccggatgctccaagaccctgtcagcccaagccatggccacagaatcctccttcaacttcttcgcagtcaagggcgccgagctgctcaacatgtacgtgggcgaatccgaacgggccgtccgcaccctcttcgagcgcgcccgcgccgcctccccctccatcatcttcttcgacgagatcgactccatcggcggccagcgcagcggcaccggggggggctccggagcctcctccgcgtcgaggagcaacggctccgtcaacatgctcaccaccctcctcaccgagatggacggcttcgagtccctcaccggcgtcctcgtcctcgccgccaccaaccggccgtccgccatcgaccccgcgctcatgcgcccggggcgcttcgaccaggtcctctacgtcggaccccccgatcaggccgcccgcgaggccgtgttcaacgtgcacctaaagggtctcgccctcgcctccgatgttgatgtccaaaccctagccacaaaggctgacggctactcgggtgccgagatcaaggcgatatgtaacgaggcaggcctggcggtgctggataggtacgacgaggacgagaccggcaccgagaagctggaaattcagatggcggatctggtagccgccttggagagaacacctcgcaacatcacgcgggagatgattgagacgtacgaggagtggtcacgacaatttaagaagacatgacggtagatttttagctaatgaatccaactcaaaaaagggatatgtgaaccatgctctctctcttccaacgctctcttgaagaggtctaatacgtcgttacggatgacattgatgcaattactagacaagaagctgaattacaaggaggtccaagatataggagatcggacctcccgttctttttaccctcgcttcccatatatcaagccgagtccccaactctgttttttttcttctttggtccagtcacggcaagtctaggtcccttgcacacttccctacttggcgaaaccaatctgtcgtacactcgctcactcttggcgactcgaagagcaacctcaaacgggggtatatactctgggacactctgggcatccccatcttcattctccctgattcctccaccgaaagtaatacagtagtaacctatgttccctgccagcctggagaacggaccattccatcatggccctaggtatatatgtgtcaaaacgaaccaatctccctctgcttccgtcccgggcaagagaacaacagaccaccaatctctccccggggcgacagagaattaacgccctccaacctcggttccttccattctcccagtaagacagggcagttgtcacgagtccatctagatacgagagaccagtgcttgtcttcttcgtattggttattggacgtccaatgcctgcccctgttctgcttgagaactcggtacaaaagttcaaacaaccttgaataatatagcaaacgattccacaattttccaccttgcgccttcgccaaataagagtcgaaaatgtattagaaaacgagatatcatgaagagaagcaatcatcaaatctttgtggcaaaaggtgctgcatagctccacacacaagataccataaaagatcaagagtcctcatctgaccttgcacccccgcctgtcctgagtgcaggcgacagactgatggaaatctttggggcgttgttgcccgaaacgccagtaaaggatttgcgtcttcgtgacacgctggatgaaacggaagcattggaggctgacgagctgctgttccgtctcttgttctgcattaatttgccaatctcgtcgtcgtcggcttcttcacgtcgtcgcttctcagtgatacgctcagggggcccggttgctgagagtgccgaatcgttgccagagctggtgctgcttgcatcgtcgccttccttttccttctcgggggttccctcggcttgttcatctgcctcctcatccgaggcatagtccaccaaaggtttgagaggagtcgaagagccattggctgtagacttgccttcttgaccgtgatcctcttcgtcttcagggtcggatgccgtattccagtactcctcctcggccggatccatggtgatgtgctccatcattcggtttgttggtgttggaggtggtcgcctacccacatcttcctcagcttccaaaaagcagtctatgttgacagtgtatccttgtgtttgatcgtaccgaagtaggagatcgcggaaagttgacatgtggcccaggccaagtaacttctccctgtaattcgacacaaggtacttcaccaagtctttgacgttctcctttttgatgtactcgaagagttctaacgaggcggagctgagcaagttatctcgtgacacggcggatatcaacacatcgagaagtggaccgagtactgctttctcagtcaagtgcttgatcaaaaattcttcttgcattccgatcagggatctgaagaaacgaattgcaactaagacacgattgttagaatattgggctttatgtgtgttggccaattagcgcatacctaattgaagaaacttctctgaagagttgagaagctgaccaactcgctctgcaatgttgttggttaaaacaaaatatctgctaaaccgatgatgctgccgaaccaagaaacacatgatttctataagatagctgaacatggacgcttgctgaggggaaaaattcatatcagttcggtgttccagatcaagcaacggcttgaaaagattgggtgcagatcgctcgtagaaccgtgtcaggaacacctcctgctgagggtccatggcggtctggggcctgggcctcccattcatctctccattgaccttggggaaattctccgggccaggatggtttggcggtcccagatccagcaagactttgatagcctctgatatttgagacttcactcctagatcgacttcgacaagcagaagctcgattagagaatccgtcaattgcggtttgttctcatgcatctgtcgataaatagtttgtcgaatcatctgagggtcgtggtcgattatcgaaaccagaatgtccgttgctccgactcgtacctctacatcgttatgtttgaggccgaagttgatcacagggagtagtccgtgggagagaaagttgttgtatagcgtctgacgggcaggtggttgaatattcttggcaatgccacagcattgctgaataaacagcaccgcctccttgcgcttcttctggttgcgaactggagacgcaaagatggcgaacagatcggcaagaaagcttgaattagactgcagatgctggacgatgtcaacctgattaaagaaaatcaaagagttgagtaccgagaatgtaggatcatcgagtattcgcgcaagcacgacgtccttcaaatattgcaggcgataggtttggtgaatcttgcggcgcgtttgctcgtcctcgatgggaactacctccttgtaacgacccttgttgtcaagccagtgtcgatggttggctttgtggcttgggaaatccgggtcatactccaaggcgcctacgacaccaaggacgcattcatcggatactgcatgctcaataatcgatgtgtcatttagaaggatgattgtcttcatgatgttgcaaagtcggtgaagatctgacaaactctccaagtcctcggccatttctaccagagggatcaatttgctgatgtagtcatcggccatgatcgatttagagagagcgtcacgtccgtttgctgtagagctcatgatgcgcatgctggactcgatttccggtaggttgcccagctcagcctttggaaggttgattgtcggaggaacctcaatcgctaggtcgtctgataagccctctcctaaattcattcttgtcagccggtcgcgttgtgtcattactgtgggataggtaacgtaccggctccgcccatcgcgttgtggaaggtttgttgaatactgctgacaaaccgcctaggttgatgttagcgatccagcaatcacgaatagaggcgcgacaaaacaaaccaaatgatcgcgcagccctcggcttcctggaagctgagggccatgtcgacaccggtgcgaggctcttgccatacaatgagagtgtctaaggctggtgtgtcagtatatgccagatgggtgctggtatcaagatgggttgggcttgccttgctgcttctgaaagccatcttccttttgaatcttcgtttccagaagaagtcggtcgggttggtcttcagactcgacaatcactcgggggtctttgcggccatcttcagtctattttgcgaacagaaaacaaaatgtcagtcacgcgaccagagtcggctggggatgcatctagcagagggagcagagaaattcagggcaagagcacgggtggaggtgatgggaggacgcacagttgcaaaggtcgcggtgcagaaaccggtaccgcgatcgaaccagtcgttgtccctaagctcgtacacttttacgcgcttcttgtccgtggcctgatgaggcaccggctgtgccatcatcaatggctcggagtcgccgccctccgtggcgtaggagttgtatgtgaccaggctcggggtgatgtcgagatgctgttggagagaaagttcggaagctggttcgttgtggctgaggatggtgagcgccgccacgacgtcgtccttgttgcgccctgggtgaggggacgcgcgagcttttgcaaggaggtccaaagcaaaaaagcagcacacgacgggctacgggcactggtgcgacgtagttgcgatgcgcttcagtgcgccatacaagtcgtgcagggtacgtgaggggggtcgggagctggagagacggcagcgcgtggtgcagtcaaggttgttgcttgggctggattgacgacgtgtgtggtgtcggatgggatcggaccaacgaaaggctggcttgcgaaggccagctaacaggcggaggggcagtggcctgtgcgcagcagaggctccaggtaccagagcagggactctcgaagcgaaggccgaacacgcgattgccaccagcaaggacggtgcagcataaagtgaagcgagcgcgcggggctgaggcaatgctcgagttagatccgaagcaatgaaggagccaagtctaccgccgattgtggcagccggcgggcagaatgtgacagagtagcgggcagatgcgcgtgactgggtcgcttttgggtttaggcagtccggacggcagcacgaaggtgcagttgggcttctattttttcctcctgggtgccgaccaaggcggcagtggagccagggactagatgtggctggagggtctgtttttcttggtaaccctggtaggcaggaaggttggggggcgccttactccccttcgtgcgctgtttagccgtgggagccttatcagttgcctcaaaacgccaccggccccatcacgtcagggtcacgtgcttttaaggggcaagtacctcaacacctcgacacggcggttaagacatggaaaagtcttttgtgtgtgttttcgtctgccgcggatatattacgccatctccgaatgccggtgtctcggaaccaacatgttgatcaaagagcgctgttgtctgtccctctccgcccggttgatgtcatgaccctgtttctgattggacaccttgggtatcatggggtgatctattacggtatatatgcccaacttaccattcccattctgcccgtgcgagtggatgacggaccttgatggccctgtaacacagagtgctccccctccgcgttgggtccaaccgcattaggcgcatggcatcgtgcatgttgggctggagagatgttcgtacggtctagcatcggtgcaaggttctgctagttagcctagatcatgcccctgcaacgaccaatgttcttcttttccgtctttctcgaattctcatggagtggaaagagttcggttccccagggttttggactcttaatcatcaaccggtcgcaggtttctgtaacctcgataccagatcaccgctagtgcactagacccccacgtggcccaacaagttgacaaaatcttcgctggtctgccacaccaatgttacataattcaccttctcgaaccacctaccttggcctgcctggataaatagacgtaacgtaaccacaacattcatacatcacgagccgcgagtgttctgcaaatactcccatccaccctggggattatccacccagaataattgtcgcaacacccgctctatctgggttcgtctcggccttgggggtccgatcgcacgggtattgtatggggcattaatctatatcaagcatagccaaggcatggttcaagagagttcggctagtgcccagcggcccatcttctgccaccaacgtctttcccaagatcgtcaagctcccgagtcccgagatgtagtctaatgatcgatgagggagaggttcttggcggaaacgggagaaatgataatgcccgactgtgcaggatgtgcatgccatcgcatacacgcacgctcccttcagcgcggcgggaggatgccaagcacggctcaaaataaatcggccttgttctgggccctgcttgtattggcttatgatcacaagccagaaggcaggtcttgcagtcaaggcttgatgtctacctgccatgaaacctcatatatattcagctcgtccagggagcaggcgcctgggaagccaatcagacggcggatccatttttcatattaaaggcggttacgtcttgaggcgtagtatcggttgacagtcgaaccctgctttcatttggtaaattcgtgtatgttggagtgcagcgataagattagtgtccttgtcaacgagagctgagaaagatatcaatcacccaggtgcgaaagcagggtgaagatatggtgtgcccgagaacaccatcttggggaattcgcacgatagaccaaacccaagaccaccaccggatctctcggtggcacggaatgggccaacgtcccgaagatagcggcgcagggatgttccagcaatcctccgaaatggttggctcaaacagcaagcacacatgggcagagctgaagaggggcagcaacggttcggacagctgaacaaagaagcatacatgggctgagatggtagtgtcctccgctactggatcaacaatccctgcaaatgcagactaaggagggtccaaggcggaaggtctgcatcttattgattaagcagcttctgctgtgctaggcatggagcccgtatttgctgggcttccaggtaatggaccatattggtttacctactgctgcatataacttaccattaatataagatattgtttgatatcgacgccacaactggagagcgacgagctgatgaagcaggcaccagcccaattatggataatctaacattataaacgagctgacagcattgaggtggccagactctttgtccgcaatgcgccgagcgtgcatcgcaatgccaacagaaaaacacatgggggtcgctattttccctcaccgagaagtagaaggctgccagcaaagcaaggaagaaggttcatccaaagagcaggccggggttacattgaaacgtaatggatgttttgcactatgacaaagaaaggtctgtaggtagatacacacacagggccagtactccggctggcggttccaagcagcaacctaccaggccaaaggttccaatactcgtgtgagggagggaggtaagataatgggctgcgcgcgccgttgaccgtggctgcagcctgcagacaacactgactgcagtagcgtgcagcccgggtggaggccccgaaccccctagccccccctacacaggacactagacgctgccagccaggcatcgtggccgctgtggcgagcgctggccgttggaacgcctcaactaacggcttgaaccggtagcattgaacgagcttttaggttgccatccttggatcttccttctcccttgcaccctgttccaacgcccgtccatgccatgggccacccatgataacacccatcccatctatcgtaaaatgatattatgggctcggcattgcattggctgtgcagtaggttcctgagtcctggctgcatcgagcacgctgcgtcggcgcccgcctcgtatcttctccatccatctccgccaagcatttggaacatgtcgcgttggctccccctcgcttgtcaagactcattttgataaagtaccttactagtaggctatctggatccagataaataaaccatgaacccccgtttcccccatcgctggaccagggagcggcaagagggatgaacccagtccccctctttccaccttcttctcttcccctggtctgctctctagtcctcgttgaacatatattcacgccggcgcgtcttcgttgctttctgcttcctcaacttgtacaaccaggtcttctcctctcttaatttctccaattttccatatcacgcctcatcgccgtttctatcccccacttggcaataacactcgcttaggatctctgggtcatcagcccagacttacactccagccgaccattcaacaaattccccatttcagccgcttccaatcctcgcaaacatagttacattcccggagctttattgcttctcgtcgtaatccagacgtccagtacggcaccgcgccacccttgccgttgtaaaccggcggctaaatcagatatatcctggtctccagctgccctcaccttcatccacttctacgccaaggcccttgccgtttcgctgcactatttgtccgggctctcatcagtacctgtcctctctatcagctgttcctaatttctcagtgctcttctccaagaattcagtcaccaccaatttcatcacccaccatgagcatcacaaaatagtccaagatatcgaccttgcgccgtcgacaaccaacccctggattacaactgaggatatctgatagcgtgatcaagaagataggctcatattacagagccagttctgccaacagccctgtctcacctacttgatacaatttatacagcgttcgcatgagctgcaagctgcatatccacctttgatcatacgcatctctactgggccacaaacatcttcacaatgtctatcttctccacaatccgaaagacccggaaggacgccaaggaccaaaatgccaagttagctgagcagaagaagaaagaggaggagacgacaccatatcgccatgtccctacccacgcagccacagatgcgtttgccagtgcgccccccagatggagagaggctgccgatcgagccagaatcattgagcataaccaaaggcgtagcgcgatggcatcaggttcctcccaattgagcctgccctcagccactgttccccgcgttgggagctcgctgtcatatgtctcatttccaggaagcccattgagcctcagagcaagagtgcccaagtcgtacagttactctggtgtctcaccttactcggatggcaaccgcgatgtcatatattctgccccaagtagcgcttatgcaaagcccgctcctttcaaagagcagtggcacgcggagagcactagcgatgagaccagctcccaggatgaacttgaaatgaggaagcctcaaagggaatctgtaccccaatcgaatggacccaaagactcaccccatcgtcttcatcctgccagccgttccaggcggacttctgatgcgtcccttgacagacgtgctgtatccaattccacatcccaaaaggcacatggaaagtcgacctcctcccgagatccgagacctcccccttctatgagaggcttttctcatacgactccaacacccccctcggtaccaactcaatcatacagtgcccccggaccaagtcctggaaatgatatggcgacaagcccaacccagcctgatgctacgaccgtgcgtaataccaagtcttcccgccacaactcggccccaatcctcccaggactcacgctggactccacaaggctgatgcccacatcaaacccttcatctcctttggccctcgcaaccactgtggcggacgattatctggatagccataccaccacgcccaacggcaactcctcggcttccaaccacgaaccgaacgtgccggctatagagccaacaaagagccaactcaatgtccaaagtacggtcatcgctcctccgtcgttgccattgcatatggttgcgccttgggaagatgatcaaaatcgaggcaagcacctcgatggcaaggtcgagattgttaatacatttcctgagcgagctgcagactttgattctggtgattcaccgaaacacaagacgaaaagattcagcaaaagcggcggaaagctgctaaagaagcatcgacgatagagaaaacgggcgggaatgtccggggcattaatggaaggaatccatgcttcaacttgtttgtatacgcagcctatatggcactactagatagatttggtttggggtttgaaaacttttaggcctggtttgtttttgcctttttttttgccaattttttcaatctctggttgatattctaacgacctgtccaatcttgggattcggtgtcattcgggtggctggttacttgctgagtacatatacatggagactctgttctgttgttcttccctattatcttccatttgtgtaaacagtagggttatggtggcattattagacaccagatgatgttatgatgaatacaatgatgatcgagaatatgcactagtttgaagcccagttgggtacgtttgattttccaaaaccataagggctggtcttatcacggtaattttgatacaagccctttcgtagtcataattgcgccgatgcaggcctgtaatcaaacgattggttgccttgggacctcccatggtatcaccaggtgctacatccaggagcactgttgaggcccgtagcgggattcccatgccaaatgttgagactatcttggcacagcaagatgcggtgttctacttgtcacatcgagccgaatatccggtactagacaggtttctgctcagcgacaaatccaagtgatccagacaagattgagaaccacgacacaacgtgtgccgagctcattcatccacctcgaccaatcagaaggtccaattgagcagatcgagacattcttcattgcccctctaccccgcggtcttagatatcttcagagtttcagcacccctgttaagacccccccacccccttggcctcgccgagatggcttaaagaatgttatttatatcaactctgacctatcgtttcgtactcaatagtagcatcgctcactggctcatcagatatatcaaagccccatacgtaagatgcaagtgcatggcacaaaacataacacgcctcagccaccaacattatcccgcgactattacttactgtacgtatagacaactaaatcgatgcagggctcagtataaagaaattcctttgcccttggcttctacgctcaatttaaagcaaatcgaagtcaagtttaaaatccacttgggtgaggcaaacttgggacatgaccattgagaatcttcattccagggataggacactaggaaagaatagctctctatgagaatcaccgagctaagaagctacaaaaccatcccggattataccatctgtaagaattgcgactggcagtatcaacttcaataagactactaggtataccgcaaatttcgagaactattacctgcagtatcatccgagacttgagtcgctttacgtgaatcgaaggcgctgctttacgcacctattcattctgatccatcaaatggacgggtctagtggacctagcagggccctggagatcaattgatgggtcagggcccctggagccaggggactgggggtgtgatgtcacctaacggcacctagaaatacgcctcaggcgcgctaaaccgcggcatccacgcttggaccccctggaaggctaaccagcgacagctgcaaactgtctccaacaagtaacctactacgcaattgcgcaacgtcaccgtttcaccaccctcaacttcttttcttcccattggcttttctctcacaccacgtagccttcccttcctttcaccttcggtatgtgctttttgatatagaactccctcattataaccaagcggccccagaagccgcccgcattccgaagccatgtctggactggacatcctcgagtccaagctcgcgttcttgatggagcagatcaactcggtcccggtgcacattcagttcgctggcgtcgctgtagttgcactggttgcgcagacgctggtaagtttcgcctttgcagattcgacgcctccctaccagagggcgacaacgaggtggcgagcctaacattaatagttcttcatcttcctccacatcgttgcgcccaagccgcgagccgtgctctcctcggagaagaaatacgtcaccagccagtccacctcgcgcaagccctcgaccccacgtgagctcccgtgctggtacgaccgttggctcgcagagcgccaagcctccgaggccgccgaggacgacacttccccgacacctggcatcggatccattgagcccgccgaggtgcggctgagcgtcgtcttccctgcgtacaacgaggaggaccgcattctcccgacactcgaggaagctgttgcatggctcgacgagaacatcgggcggactggcagtgctaagggtgctgctggtaagaccaacaagcgccatgctgctcgccacgcgcaggacgggaaggccactggatacgaaatcattgttgtgaacgatggcagtaccgacaagactgtcgatgttgcccttgaattctcccgcgaaaacaagcttcacgacgtgctgagagtcgtctcgctggaacgaaacagaggcaaaggaggtggtgtcacccatggtctgcgtcatgtcaggggggaatatgtgctctttgctgacgcggacggcgcctcaaagttcagcgatgttgccaagctgattgagggctgtgaggaggtcgtggatggcgcccaccgcggtgttgcaattggaagccgggcccatctcgtcggcagtgaagcagttgttaaggtgagaccaaaccaaaccatttcttcaaaacccgtgcccacggactttctgacttctttatcctaagcgctctgccctgcgtaacttcctgatgcgctcctttcacctcgttctcatgatcctaacgccacctgccacatcccgcattcgtgatacgcagtgcggtttcaagctcttcacccgcgcttccctcccccacatcgtgccgtacatgcacacggagggttggatcttcgacatcgagatgctgatgcttgccgagtctgccccctccatccccattcacagtgcagatggcacagtcattggcagtagtgctggcatcaaggttgcagaagtccctattgagtggcatgaggtcggtggcagcaagctcaacgtcatccaggacagcatcaagatggccattggcctggcagtcttgcgtgccagctggatgatgggcgtgtatagaagacggctgacctagaccacatgagaacactcgtaagtggcttccctaacaaggcaaggctttgcaggcagagcgctggcgaactatcgcagccattcttgcctagtttgatgtgtctttgcaacgcattttcgtttcctccctatttctacaagcactctgcacggcgtaccaaggttaagatggaacagtctggtgtattcagacctttttcataaggcaaagttttatagacatgctagatacaggtggctaccatgacaaaacaataagaaaaagcctttttttttccgggcatcatgcatgcggcgtttcttcatagctggcaaattcctgctagtcagagatcattgcactctctgcttgacattagggattaaaactgatgaaaatgtggaaaaacacaatagaaatacaatgatctctccatgttgtttgtccataagtatgtcaaggatgtctcttttcttgtttcaagatttttcctttcttttgcttctgagccgtgaagaaatctatttttaaatccaagaagcgagaaacaatagagggaaagtcttttctggtaaatttcgaagagggatttgtgataatgacggtcggggccgggtgtctctcttttgggagggggtaggatggatagggaacggcttcctcgaaccttctcttcacttcagaaccatttgctttattgtatggttcagtattttgatctcccaccacgccaacgtcaaactaaaaaaaaaagtatatggaggacaacagccgctccattaaatggaacatattttcccacgcagggcgcctcaaacaccaaagcccagaatagaattaaaaatatgggtgggagagtgggatttgaagaggaagagactgaagagggacaggaaaggcctgaaggatatacagaggacgctttcactggaaaccttcgcgccacattacgggcagaaacacgatgcaagccttccagaggatcagaatcgcgtcaatgaaagccaacgggagcttccacaggcccaacggtccgccgatgacggcacaggcattcagccagatggccaagaaggcgaccgagaagaagtggtagaagagaacgatggggcggtggatgacagcagcgaggaggccagaggggccatcggtcatgccgcgctcaaaataaccaaagcaacccagctggagggcgcgtaattggcgatcgtttgcggcgaagagagcgtagagagcctgagccaacacgttgaggattcccgtcaggctcttgcggcgccagtagagagtgtccatggcattcttaatcgctcgagagtcttcaaagctagggattttgtcggggtggaggagctcggagagaatgagacaatcgttaaacgcaacagtcatacccgagccagtgagagggtggcgcatgttcatagcgtcgccgagtagaatcagaccgtttgtggattgcttggaaggcgggagccaactgttgggcatgctgcgaggaatcttgccatcctccaatgccttctcgactgatgggcgaatggcgtctggaagtgcgggtagaacgcagttttgaatgtaacctcggacacctccagccgatgggcttgcctcgggcaattccgtaggaacatccattaaaattcgggtctcgtgcgtgccaatctggtagaggagaaccgggaaggtgtttccaataatcaccatggcgtgcccaggctggggcatttggcaatcaataagctcgagggcgtagaatttgcttttcacgacaggagtagtgtcgataacttgctttcgaaatttggaagcatacccatcagcaacaatggtgagctggccaaagaagcagtcggcgcgcttctcgcccgtcactttgtctaccgtccttgtttccacacccagaatctggtcttggtagtctccacgcacaacgttgacgacttccgtctcaacgactgtgatgttcttatgtgccaagcaggactttcgaagctgcatgatgaactttccgtggtgaaatcctcggccaacgggcctctttccttcctttccagcaccggaccattggtggtctacctggccatcttcgtccaatgttgggtatggaatcagcaccggttggccgtggtagctgacacagtatccgtagcaggggatggcgtcgatgttctctaagcaatggcccaagcccaactttttgagggctgcaataccgccgggctgcatcagctcaccaacaatacgatcaggctcgtgcatccatctctcgagtagtaggacggaacgcccctggtttgccaatgaaaaagcaattgcgcagccgaaaacaccagcaccaacaattacaacttcggcttcgtggaatttttctcggcgctctgcgcgatagtcggcggtaaattctgtcgccatagtggtcggggaaagggggtgttgtgatctccagacgtcgattaggggcggggagggtcgagcttagcgacttcggctgcgtgaacaacgacggatgttcagacgagaactcgcgttcggctgtaccgagaggcaggttgttgagatttcgaccaaggcaagaagttctaacatgcgggacagcaagtcatcgggttcgttcctgatactcgagacgagcgggtttctctcatgcgatcgatccaattgcttgcgggcgaaatggtcccgaagacgccgacttggttctcttgtcgggtccgtcgaagtcacgcttattctcgaagcaggccgggtggggttgcgtcagggcaagcagacgacagtgagataatatatgggttggcgaagtcgttcatgagcagcctggtctctctctgctctgcgagattgaccctgaaatccacccctacagaaagtttggcttacaggggtgctgacacctgggcgaaaggcaagtggcgccattctggccctcaccgccccgccaccgaggacgcccattggctaccagcccgcccgattctctgatcagcgggcatgtgattctggcaccgcaaccttgaatcgtacgattagatcgaaatttactaagcagccacccccaccaaacaccttggtggtgagcgagctcgaggctgtgggctggacctggaatccacgcggcacatcccagatcgagccaatgagcatcaagttattgtcgatgagcctaccattttcgacacccggtgcaaagatacacgtgtaaagtacattgagtagatacattcagtagatatgtattctgcccgtccagggcgtgtatgctaggtatatagatgttcctgaaagttttatacatgcagaatgaatggtttcccgcccagcgtttcaagactcgtgtcctacctcacattgagaccagccgggaacgacccgtggctgtaaacttagaaactcgtacatcatcttcttctcacctgtcaacaagctccttgattcactgctcgcaacgccagatgatatctcacgcacattatcgccatcaagtttcatcggaacaccttcgtctttcgcattctgcttcgcgaacgaatttttaggcttttcctttgggaatacatctctgcttcgaacggcgttgccttccatttcagaaaagtagtcccagttcgggtcaggacgttgcacagcctcttgttgcggcttcttttccgctggaatactcttattctcttgaaatttttcatcgacgggcttttgacccggccccagcggaatcgtgtcctggggggtttgagcggtcatgacagtctctttgtccaaggtgtttgacaacttgtgggaggtgatgacatcgcctgttcttgcctcgctaaactgctgggcatcaccaacgccctttggcaacgttgataatgatgagccatcattgatctccttgggcgggcacgagctgacaacttcaaattccgattggaagacgttgcccatgttcgaattgatgtcggcgttgctcctagttgacggggcatagcgttcagtgcgctctgaattgaattgcaaagccatgtctaagaaagataaggcttccgtgtgtgggctagaagcagattcagaagccatcgcaatccgcttcactactgtcttcatgttcagcttaagagtgcgtttgatagcttccgtgccgacccagttgggcttcttctccatcagagcagccataagtagtttcaagtctgaataatgcagctgtaggatgtggattgagacaaggttcaggaatatgaactcttgatacaagaaatccccagagccattctgtgagattgccatctggcaaattctcagtgcgtctgcaaggtggcccagggctatggtcttccgtgcagcgaggttgtagaccatgtcgtgaacacgcaagccacgaccaagagcgtcgcggataatggatattggaggctctccattggcaagtttcgccattaacactgatgttgctgcgtcgctcacgtcgtggccctgagagcaagaccagagaagtctacttgcgttatccgtcgaaccgccatccagcctgactcgagcaagaactgcgagccgaagacatcgtatggagaattttttactactcgtagaacggaatttctcatacgattcccagactagtgaccacttgcactctcgtgcatagcgctgcatagaatcaaacacatcagcctcttcctttgatagggggcttggtgctagttcccgagcaactcggacgtataaacgctcccaatcctcgcgtgctggtacagattgcctgctcgagggagtgccatccttctcagcatttggggaaatggctttagtacagtcagcaagagtgtaattgtggttagcttttcgcaacaaggaggcgagtctgttcactttctcccaggacatgtcccaattggtgtgacatttctggtagaatttgagaatataagcatcgtcaacacgaaagttattctgaagacagaactggatccaagagaaaaccgtgtcaagcccattgcttctgaaataacgcgtaaggagtgagtagacccatcgaccctgtagttctaggccatgagtctgggtcagataacgcacaatagcctcaaagttggctggcgcatgccgtctagagcacgtgtccacaaggttggcaagaatgccttgaaattgccttcggctggcctcactaacgtcgctctgagcgccgctttggtacggtgcaggagaatggacagcttggtatatgccatggcgctgcatctcgtcttggagaagaaaactgacgagttgacgggtttcaaagtctccctcaagcgtagattgagaatttgaaggcagcctaggcgaatgaagcatatgatacaattcaatggttcgtgacggtttttgatagagggttgaatgagagaccaagatacgatagatcgctttcgaatccaattgatccacggagcactcggagttgcaaaactcgccaagaaagcttggtacacggtctgcaatgtttgcttccatcatccagtccaagacgacagcaaggaccctgtggacgtccttgtgaaaacgacgcgtactatttaacgctgaaacttgatgttcgccaaggagaatcgcaactttgatcagtgcaacagaattggcctccatggcctccgcatgtaagcctgtcgcagtaacatgtgacagtttatcgaagatttccaacgccatatttaaccttgaagatataccagcaactgaccagtccctaggatcaaattcgaccaagagcttgttcaagaggggcaatgccgtgctatcaaatgtggtctcagcaccagatgcacggcccaagaaatccgtgactgcctgagtcaatgaagaatccatggtggaaaaggctcccacatatggacgctcataagaattggagcttgatggaaccgctgctgtcaaggtagccatccccacttgaaaatctgccggtatgcgtggtttggcatgatggttcgtgtgcggaaccttgggtcgggaactttgagaagcgggggaaattggcttgcccagcttaggcctactgaacgtgtctcttgaagacacagttgagcgtatgggaggtgcaccaggcttttgtccaataatcggtaagtctactgtgactcggggatttgttgaagaggacgatgaacgagcggtgcgagaaggcaagtcgattcgatcgtttcctttgatctccaaatcctgcattagatttttctccttgttatggacatcggaatcatcggatcttgaacgaagccgcgggcggcgtttccgtcgttcgggtttgctgattctctcaattaataaagcctcgcagtcttcgtccgatagccttgtatctgcaagaagagcaggcctatggcgggccttcacagtgtgtagttttcgtgcattatcgaaggcagatcgtgcaatccgcatgcgctgtctgcgttcctcggcaagaataaatactgagcaggatgttgtgaaaactaggcctcgaagagcgttgagcgcggcccgggaagggaccggtttagacgacaccattgtcagtggccatcatcccagcgccaaagccggtgggaagatgtaagagggggtccaattgggcgtaaagaaggtcggaaatgtatatgtcgtgccaaaagctggtcgtcagtgaggttgtccagtaccaacaatcatgggcaagagtcaaagtaggggacccaggcttattatgtaagggctggagcgggcaggtatccacccaatcacacgcctctccattttttaatggcctgattcaccgaaccaccaatgaaggctgacatgttaaggctgacatattaaggacaacagccttgataaccagagtcaattgaattggttcctgcataggtaggaatcgatagggtaagtcctcaggtttggctagggtttacttgcgcaagatgcaacgatgcccggaacgagggttcgtacgcacatcaatactttgacctaagccaagtgcccgtgcaacaccatcgtgactgccgtctcaatcagaaccgacgcgtaccaatacttttcgtgtagagaaaattctgagggttttctttttctccttgtgcatctcccatagctcgccatgaatcttcccatgttgatttcatgatgtccgcaacacctttagcccctcctcccgtcagcccgctcgcccggtatcgcttgctgtcgccgaatgctgccgtaaaggtcagtcctctatgtctgagcacaatgagcttcgggaacgcatggtgagaattatattgatttttgctcgtgacgccgtatacaatctgattgattaatatggttgctcataggaaggaccagatgggagatcgtagccagcgtgaagttgaggctcttcttgattacttttactctcaggtaaggactcaagcacagctccaatttcgataccataggatctaacttgaaactaaggggggtatgcgccttgtttctgacattaaagtcgcgttgctatactgagacgacgtagggaacttcattgatacgtccaacaactatcaatttcaggaatcggagcaatgggtcggtgactggatgaggaaacgaggcgttcgtgaccaaatgggtttggttttctcctgatcaacgctattgtactcgctggatacaaaatactaacatgaagagtacagtcatcgcgactaagtatacaaccaactttgtggctgggccagcacaccctcctatcatggccaattacgcaggcaacggaaccaaaagcctggtgcagtcggttgaatcaagtttgaagaatcttcaaacgagctacattgacgtggtatggccttccagtgctttcacgcaaaagattctcagtctcacccccaacacagctttacgtacactagtgggactacagcacctccattgcggaactgatgcagtctctcaaccatctcgttgccatgggaaaagttctatatctgggtgccagtaacacgcctgcctgggtcgtaaggtttgacgaataccttcttcctgcttgctcttgtggcatcctaacctaaccaaacttttagcaaggcaaatgaatacgccaggcaccatggccttcgtcaattcgccgtttatcagggtctgtggtctgcgaactgccgtgatttggaacgcgatgttgttccaatgtgtaagagcgagggtatggggatcacgccttggggggcacctgggaaagggaagttcaaactggcagaacgacgacgatacgaagatggccttcattcaaacttcaacgaccctgaagtgaagatatgtaagacaatggaggaccttgcatttcagctcgacaccaccttgacgtgcatcgcactatcatatatcatacacaaagccccatacgtgttcccagtgatcgcggcccaaggaatcagtcacctgaaagaatatattcaagccctcgtcgttaagcttgatccagaaaacatcaaggcggttgattcagcaatcccttttgatctaggctttccccattctttactttggaaaaatgacatccctgagactccccagagtgtcagcttcttggaaatggcaggcacattcgacttcgttccagaaccggcagtacgtcagatagacctggtgcgaactcttccatctagatttccaactaacctattcatagcctatcaccgcgccaatggccagaaccggcgaatataatagagatggtttcgcagccagaagaggcccaaacccaaggttttcgaaacctcgcggcagaatgcaatgatcgactacaaacaatatctgcgcaaatcatagttgcgcaaatgaaacttccctatcatccggattactagtgttagaagtattttagtatacacaattttctcttatccgaattgaagtccaacaatgccgccgtttttgttcatgatttccgcccccagcatgatctattacctaccgtctcctataatcatatggaggagccttaagtcctacattagcacttagttagccctgcctaatacttatacattcgtagccacagttcactttttccaagctattcggtccatgtaggcacccagtcacagtggcctaccttgctacttgtgtttgacagtgtaggtattaggtgctcagcgaccgtgatactcagggttagctgagagttaattacctatctggatataccatgcacctaggagattcaaatttttacccagagaccttgtgcctaatggccaaggtggtgctttgatacttctgggtgcctgcctgaggaatctggaaggcgccacattgaaaggcaggacgctcctgcctccgctctttcccaattactacccgtctccaagtatggggccatcagaagcaaatacagacctaccataatccaatgcatgtcttttccatgtccctctcgacccagcttagcaaaaatgaattcttcagatctaaatcctcttcaaacacacggctgtggatcatcagaaagaccgagtctccttgagaccgacgaggaaaagttgcgaagccccagcccttcgtcgaggacgaatgtttcggaccaagaactcgcatcccagaaacacgaaatgaatcacaattgcgaacttggggaggatcctacgggggtgtatatcttcccgtccttttcgctattattcagtcactaacccttactcagtctcgctgagcatgaaaaggtttcaatttccaaaaacgaaaacaaggacaagatatcctcgcatcccaacgaatctcacatcaatacaatgctacccagtagtacctcggaaaggctgacttccatcaaacctacaaataaaactagacgtaggaagaggtcattggaagggatcagtgatgaagaagttgccctcaaccactccagtcaaggtaattgagacagtactgcctccaggggtacttgtaatggcttacaagttctgattttgtacaaggcccaaacaactcatccagcccttctcaaccaaagagactcaaaccagtaccgcctaatgccccccgagacatcaaaaagtgtggcattttcacttttcgacatggcgtccgcattatcgactacaggttcccaactcgaaatccaacaattgctcctcatagcagtcaagaacttcgaggctgtgatgggttcgataacccggaagcagagtgatgaaatatatttgaaaaatcaccgttagatagaaaatcaatctcccatattccgctaccactgtgccactttctggcaagagttgcataaagttccatttgtctgggagcccggctaggccagatattgccttcgattcctcctcgcacgaaatgatcttacacgcctgagtccaattggagagggcgatatgagataggatggccaaataaaattaatgaacacactcaagggcatctcacagaacgaatgcatgtttaggcatttcatttgaatattgtgcgggtatctacgcaacaattactgtggtacttttcgtcaatgccttgtcggtaaccaaaacggcgaccaacagaaagcctgcgaccatatatcaacctaaaacgccgttcccaaacgaagtcacaccaaacaccatgttgactcttacttcgatgacttccccttggcttcattgtcgcctagtatccggaattgcacattggtcagcccaacccctgaataatcttcttggcccgtctcgaacccaggacacgtcgcgatagcgaagtatttgccatcgttagaaaagtccattgccgccacattgttcggtagcttaagatactgtctcagcctcctcttggcctcagcgtcccacaacgcgatagagctatcacctccgcctgaggcaaaggtaccatgtacagggttgaaaacaagcgcattaactggataaacgatgtctccatcgccatcgggagccggttgcctgtggcacttgaaggcgtatttgcgagcctgagactcggctgtgtcttcgaaccattcgacggcaacgcgaccctcaatactgctggtggcgtacccagcgtcattgggcatacacgcgacggcgcgggtgagatatcgcagagaagactcgcgctgctgccagggcttcaggtcaccacctccggtggatataagatctcgcatcgcgttcaggtcataaatattgatgatgcggcctgtcatggcaaccaccatcttgctggggctgatagagagcgcatgcggcttcccggggagagccacccggatgggggagctggacgggtctcgaatgttatgaatgtggagggtgctgtcccatgcggcagacacaagaataccttttgcctatcgtcagagcccatgttcattaaaattgcacagcttagttagacttaccgtgggctgcgctgtacacaacagcacatgctatggccccatgtttgcttaagacagtgatttggccggtttcgagatcaattcttttcacggtgagttagcccgaagctccaaacatcctcttccagacacccaagaaccgctcgtacctattaacacaccggtcgacgcttgcagtgtaggcaacactatcatcgtcgccaaagcaaacatccagaactggcgcctggtgcttgaacttggtgatgagaggtgactgatttatctcagtttgggcaatgtcgtagaggtaaacattcgtatcccaggaagagaccagaagttttgaagagctggttggcgcaaacttcagcgcagttactgcgtcgccgggaggcggtacgagatcttcgaactgcagagctaccaaacacgttagattacagcgaagaataatgggagttgggtagaggacataccaggtgccatactgaattgtggtgctgaagctagggttgctccaaaccaatgcgactggcgagattgtttacatggttacagttagtagcttcactgtcgcccgggcgcaagaaactccgtcaccgctctgtagctacgccccaccttccccttataggttggactctttgtgttcaacttggcttcagtgcagctctcatgagacatctcccagtcaagcagacaaattctgtcgatatttatattcataattaatatatcacgatgcttacaccatcctctgaaagagggccgttgatatgggtaggtttgctcggaggataaccttaatgtttcgccagtcgaacaacaactgaagtttacattgacgtccaggtacaatcttaccaagatacctctcaccatcctggtattccttacactaaaagtgtccaaaatcgtgaacatcatgagcaggtttgcggatattcgaaactcagagctagatcagcttacccaagttgacgactccgtggatccaactttctccacagccgaaagggagccttggggctggaagaaattcgaaaccaattttgagccacactaccccgccacaccgccacaccccaccatccctcagaaagcctgctcaaaataccaaaattcagcgggaggcatgactggctgaggagtcacaaaatctgttttcttcaagcatcacgaacacgaggaactacgggaacaacggcctcgaattttcgcccaccgacgaacctcctttctcccgccacctacacgctccgatccagagccgagaatcgatccaatactgatcgcttggaggacttacctgggatacacttcccccacctcaagatcgatacccaatccacccaaacgaacattgtagtgtcgcgcgaccggaaacaccgccaaaatgtcgttaacaaattgccgattttacgaggagaaatatccggagattgacagcttcgtgatggtcaatgtcaagcaggtgggttgcggaacatcatcgccatgccacttgaagggctgatctaaccatgaggcagatcgccgagatgggagcctacgtcaagcttctcgagtacgacaacattgacggcatgattcttctctccgaactgtcccgaagacgtatccgaagtatccagaagctcatccgagtgggacgaaatgaggttgtggtggtgctgagagtagacaaggagaagggtatgataatttccctcgacagctcagtggctcatggcagctccaagttgggagtttggatattaatttcgggcaggatatattgatctctcaaagcgacgagtgtctcccgaggatatcgtcaagtgcgaagagcgatacaacaagagcaagatggtccactccatcatgcgacacgtcgccgagaagaccaacacccccatcgagaccctatacgagactattgcgtggccactgaaccgcaagttcggccacgcgatcgatgcattcaaactttccatcacgttagtattcacctcctgcgtatatgcgcgctgaagcggggctcatgtactaactgggagattagcaatgtggaagtctggaacgacatcactttccccagccagcctgtctctgacgagctgaagctctacatcagcaagcgactcacaccccagcccaccaaggttcgcgctgatatcgaagtcacatgcttcggctacgagggtatcgacgccgtcaagactgccctccgcaaggccgaggagaagaacaccgaggagacccaggtcaaggtgaagctggtatccccccctctctacgtcttgaccaacacctgcctggacaagagcttgggtatcagccgtctggaagaggctattgtcgatatccgcacaaacatcgaggctgccggaggcaacctcatcgtcaagatggagcccaaggccgttactgagagcgatgacgccgagctgcaagccctcatggagaagagggagcgggagaacgcggaggtcagcggtgacgagagtgtctctgacagcgacgagaacattcccgacacaatctgagcaactcaaaaaatcaaggagaggtgctgaggtttcagcacggcagctttcctctctgccaagtctcacggcccttaattgacaggtcaaggatggaaatttagatgcatcgaggcgcttaaaattgggactctttactggggcaaaagtatgttatggtgctgcgatgatggttctcggtacagctgacagagggcttgtgtccataacaatgccccccgggtgtcaagcaagtgacacattattttggagtggttcgcaacaggacttggtgtggttgggcgcccattagttcctgcgcgatagatgaaatcatggatttacgttacttaatgttacggagacatgtgtattcagcatactaagtatcgagaacagtaaggcaaaaagagattcgactatggtttgaaccttggagcgactggtctcttgtccgatagatgtgaggcttctgaccatttggggcagtatgaatgaacaacattgtagacctccatgtgcatcatgtgccttcacaaacacgattcctgtcgagcttctggaagcgctgcttgctgttaactggatcagggtccttgactaatttcacctaaccttgaaggcggggggaagcgctaaggttagctaccagccgctcaatgccttgccgtcatagtcgtgatatcactaacatcatcatcgctttaaaattcacgcctagatcgacgcatccccatggcggcccacatttcggacaacgttgaaagtacgagcgagtcaaaactcaatcttcggcggcagatatatgtgctaaggggaggcatcgatattcatagggggtggatagtattcacacacgtcatctctggttcactcgtgggatagtttcatcaagagaatcgcaagtttacactcaacaccatgacaaagtctctcacgttgttcagaggctcaccagcaacaaacacttatgtctggtcgccgtttgtcacaaaactcgaggcgagactgcggtttgaggatgtgtcctacaagctcgcagccgggtcaccaaagtcagctcccagaggcaaaattccgtacatacaactaggtggcgacgagaaatccggtgactctacgctcatcattaagcaactggtcgccaatgacctgctatctgatctcaacgccaagctttccccgacgaagagggcacaagacctagccatccgcgctctattggaggagaagctttacttttacactgtcagagaaaagtggcaggacaactacgtgacgatgcgagatggtgctcttgccgccgttccctggcctatccggatcatggttggctggatagctcaaagcaccctactgaagactctttatggccagggctcggggagattagacgaccaggagatttcgctgctgcgaggcgaggtctgggacgccgtggatgggctactccttgaagccagacagaaatcattgggggcgggaaaggaaccattttggtttctcggaggggcattgccaacggaggcagatgcgactctgtatgggttcatcgctgggtcattggtttgtactgcgtatgtttcccgtctccaaatcttccccaaaaagctgttgtagtgaagctgacatgtgaacagttgtcccgtcagcacagatatcgtcaagagttatccggttctgatggactatgcggggagaatacatgatgcttatttccctgactacgagcggtgggattagatatcagttgagggagagaatacataataagaacctttgttcgtgatgagcacttgatcaagtgctgtgccagacatggtattataagtaaaagagtgcttttacatgtatggaattttcaccattcaactatgcatctattcccatcgggggacacttgtgttgggttatgaataaagtagacagaacgatataatgcccaccaaccatccccagtctttggttatttgggttagggacaaggaatttttttttttacaatagtaacctcagaacccaataaacaataaacaatgatataatacccccctcccctaaaacttgtttatcatcgacatgattgaatgatctgatataccaaacccaatgttgttagtcgtggcgaaatgaaaccagctttagggtaggacttgtcgagaatcggattgcaagggggtcacgtgaacatgtcaagatccgttgggctcccttgctttgagtttgcatacatcgtagctgtgataattcgtatcaaaaattcgatacagatatggggactgagtaaattatttttttataatttcctcctttgaatatatttgagctggttggtttggtcgacgctggtttgatcttgtcgtggagcacacggattactccactcattttttactctggtcataaactcaacgacacaacctaaaggtcagcgcagcaaaggcttcgctttctagcaagtcattagatacaggcctcggaatggctcccaggtcggcatggtcgcgactgagaaaccagtcctcatttgcaaaagcggtcacttataatctcgtcggctttgcaacgtggataccagtgctggcctggattaatctgtacgtggccgagctcaccattgtggacgggccttcaatgtatccgttcctgaactcggataaggactcgaccctgcgaagggatgttgtgttgaattggaagagagcaccctcagagacgctccagagggggatgatcgtgaccttgaggtacatctactcgagcctgggattaacgagcgcaagcactggctgactaaaggcacaggagccctcttcaccccgaggtaactgccatcaaaagagtggttgctctggagggcgatgttatcaggacaaagcctccatatccggtaccaacagtcaaggtgcccgctggacatgtttgggttgagggagacggtcctcttggctcaagtctagacagcaacacatatgggccgatctccaagaggcttcttactggaagagtgacacatattgtgtatcccttcaagaagtttgggcagattaattggcgcgaacatgagcggcctctcgtgtaatagatcgctcgatcgtatgtggcgattgtgagccgtacttctacagggtggtcactgatatcatcttgcattgtactgtaactctgtgtatactagccttttctaaagggcatagaggtgatagagatgctgctcttggacggacagttttctgtgtaatttagcgcaatattcctgtgcgataataggcaactgtatcaataaagaaatcataccgtcaatatgctcaacatgagtcaattcaacatatcgtcgtctgttaatggcgtccaaagatcccaagagtcttagccgatgatttgcgtcgatcgatttgccgttggggctgtactacagtggggcagccaacggtacatgcgctgtgctgccggtgccctgcaagatcaatgtcacgactggtagctggcattgagtcggcaaaaaaaattacaggaaatccggctcgccgacactcctctatcaatttcttctgaaccaacacatgcgctcggcgcaaaccgctttcacgacctgcgtaacccccagcacccgagcctcgcttgaactcactctctcccgtttgcgaggtctctgcggcatctacgccaaatcattcttttcctcccctcccctcaggggccgtccgttcgatttcctcgtccctcggcgattgcggagcattgggctggttgcgaagacataagatttggccaggaggtcgtcatgttgggttacgcccagacgatttatcggaaagaaagtctggagagatcatagcggacaccagattatgggttctcaagatgacgttgaagccgaggggcgcccgccatattctcatgtcagttccattctccttgataggttgtttttcatcccattgacaggtagtgtaggccatgattgcgggtggtattggaggttcggttggtgacatgttgatgcactctctcgacacggtaaaaactcgacaacagggcgacccgcacgtccctcccaaatacacatcgcttgggcagtcgtattacactatttggaggcaagagggcatccggagaggcctgtacggcgggtggattcctgctcttggcgggtcgtttccaggaactgttctgtttttcggcacttatgaatggagtaaaagatttctcatcgatcatgggcttcagcagcatctgtcatacctttcggctggtacgggtcctttcctctttgatcctcgtgtacgagtattctggctgacaataattctccttttctaggtttccttggcgatcttgccgcttctattgtttatgtaccctcggaggtgctcaagactcgcctgcagctccaaggccgttataataatccctatttcaaatcgggctacaattaccgcggcaccattgatgccgcccgtaccatcgtacgcacagaaggctctgccgccctcttccacggctacggagccaccctgttccgtgatctgcccttctcggcgctacagttcatgttctgggagcagttccagacctgggcccgccgttacaagcagagccgcgacatcggcgtccctcttgagcttctcaccggcgcatcggccggaggtcttgccggggtcatcacctgccccctggacgtcgtgaagacgcgcctccagacgcaggtcaacgagccctccaagacgaacgccccgagcccgcagaagcggcacatctccacttcctccccgagcacccaccgcccaaaacccggggcgatgaacctgcagacgtcctccgtcatcaccggcctccgcgtcatctaccgcactgaaggcctggcgggctggttccgcggcgtgggcccgcgaggtgtgtggacgtttgtccagagcgggtgcatgctcttcctctactcccgcctcctccgcactctggacgtctggatgtcagtggagaaggaggacctgtaatacaataaacgttgatatatttgggagcaatcacgacgccagcctttgttttgtattaggcgccagatgaccatatttgtataaatagaaagcgccatgtgtatgaatgtgggagaaaatgattttattgggcgttgggggggatagaaacgtgtggaaatctcatcattcatacatagacatagacaatagattatgacatttttgtctcactcactctgcactggtctatgggtgttccggtaagacggccaaaagcccgacccacaaacgttctctccatttactcaagtcactgaatgagcgatatgcatggggagaattcaaaaagcaaaagtggtaggtaatatttgatcaactaatctaaacagacccccatcatcataatagctcatgcggtaagaacaatgcgttgaaaggacttaaggctgcgtgaatgtgaatattgaaaaaaatgctaatagacgtgacggcgttttcgtttcgttgcaactatgttcaaggatcacctattcatccaaccgaaaaaagcttaagcatctgggtcaaattcttcctctgcaggaaacggcgagaaatcttcaaggcgtgacattaactcatcccgtgcagcacaaatgggcacagccagggtcagggcgttccagacgctctggtttttgtcgaaaaagtcaacgtgaacctggaagctgacaatgccagcgtctccttttgaggagtccagagtaagtacgaacacgttggtgcccaaaatgtataggccatatacaactgggggctttcggcgaaattctggactggcgggagttcgtggcggtgtagttgtggacttgggtgcaaccctgtaaggggtagaaagatccccaaacccatcgacctcggtcagctcatcgtcactagagcctgggctggcgatttgccgtcgctttagagaccggtattcagtatcgtgtactgttgcaggagagtccggcgacattatggtcgtgtcatcatcaactagatcgggcgtggaccgtgttgattcaagactcctcttcattcccgctctgatacgacccgttagtgacttgttggtgatcctttttggtctcattaatcgtggttcagttgaggtccagaagtcatcacttcgatcgactcgtagatgctctcgctgcagcatggctagcgctcttatgcgggctgtcatgtaggcaaccacacgcgcctcctcctcgggcgcctcgacgacttcgacgataatgttggggataatcttaagcttatcataggacccatctcgtgctgcccagccaagggttttatccagcctcgccttgatgagctttgctactcttcggcgggctgtccgctggtttgtgggtgagagtaggttttctgattcaatcagcgtcctgacggcgagcgtcaggtcaatcagctgcgacagaacatgtgttgctacatggcggtcagtaacgtcgaagtgagaaaacaggtgccatggccttaggaaggcaagggattcataccagcaaattggcctgacatggtttccgagtgcgagtagatgacgggcggatagtcttttgaggtctgaaaaatatggtcggtgaggggaaatccacgtaggtcaatactccaatgcggcgggagtatgggaatatcttgacgaaggtagaatatctcgaacagccgctcctcctccttcgcccactcctttgcgccggggaatttttgtttgtcttgttccattctgtctgacagcgacatctcagcttcttctgtggcctcatttgcttcctcagaattctcagcttcagaatcggaggcttgctttgccggtttgtctgcgttggattttgccaattcgtttcccttggtggcggactcctccattttgaacatgctccgaatggattcagcccattggatcaggctctttgttgacagagccattgtcaagagattgtctgtccacagacagatcccagaattttgtctttgttgaacgaagacacatgaaacacatacaggaggacccttaaagcccaggcaaaagcaggtgccaaatgacggtcaaggatctgactgctttgtgagtcaagatggaggctctgcagctgctatctgcagctacggagcctggtgatgattgaccagaggttgagtcacaaggcacaagagaaaaaagtgaggctacgaggaagtgagaggaggtgtgggaagaaaacgcttgccttgttattgctaccacaaacggtaagtacctgggagttcccattcacacccaacgacaccatcatgcatgagcactgaagcccagtaataaacccggttgtcagtgacaactgcaggtacctaaaagtggagaggttggttgtcagaaagagcaggcaaacagggttcaaagtcttggagctggtgcagttcggcaccggaacaagtgagaccccgcttcgcccaatcagcaccccctgctatcattgaatttcttcgtgctgagaacttgcgatcttgaatgtacgttcagaggtatcttccaacggcgaccacaaagaaccatggccgaggcagtgagcgtcgcagcaaagcagctgccaaaatttaagctcggcaagaaacaagtatttctgtatgtgttcactggcgccccaagccagtagctcttcaattgcccccatctgttcacacattctaattgtagatcctaggcccaaccatgtaatcacttttttacgaaaagaccaccttccgccaaacgaagcctgcttccacgttcctctcacattcaccaagtttgacctgcgcgactacctatggaatttatacaatgtcgaggtcaccaaggttcgctcctatgtcaaggagctgcctctcacacagaaacccggcacacgcatgtggtaccgcccgcgagcgcagaagatcatgacagtccagcttgccaagccattccaatggcctgaggtccccaccaacacagaggcctggagcaaggagatgttcgacctgcgggaggagaagtacgaggagaacaacaaggctcagaccgagaagcaaaagatgcagctcccaatgaagagcaggcaaccaatcgcccatgaaaggaaggaattgtcaaagctggctaagcaaatgctgacaggcaacgtgaagtggtctaacgatgtcattttggatccaaagtgggacagtattctggagcaggctacgcaacaaaagcagacaaaggaggagtcaaaggaggagtcaaaggaggagtcaaaggagacagagccacaagagcagaagaagccttagggctttgaggggagcatatacaaagagaaggatatgtccaggaggcaacctactaagttgtcgtgggagaagatgatgaaaatgtcccacttgtaatatatcatcaaattgtgcatgtataactactgtaccaagcattcagagcatttactgaaatagtcgggacaataagagaattgcacctcggacgaaggtacgcatgatgttacttttgatcaacccagtggtgcgcttcctgaaactgtaaaacctcgttcccccaactccaccagccagctgtcaaattacgtgcaaacacttctaacgcatcgtagccaggttctaacagctcatcaaacagtccacgcaggttcggtttccttgaatgcacatctgggactgcaaagatagttttggatcgaagtccttgaggggttggggtcccagtacacttggcaatcaggagtttctcccatggtttcctccaagcagactcaacgtcaaagataggctctcccgacgcagtgaccttgacccacgtccattcagttaccagctcaagaccccactgggcgaagagtcctgaaggcgaggaaagaaggtcaattatgctaggcttgttagttatccatatggcaactaggccatccggggataagtgggagggaattggtatatgtgagagtagctggcccatttcatccagattataagccgtgctgtagccagcggttttacgtcggacggagcggtttggccagggcgggtcaagaacaaccaatctaaacttaggtgcagattccctacattgcgagctcaactcctgtattgatccgtgtaaaaaggtggcattctcggggatgaagggtgctgatggtggattgggcgcatcctccaggtcagtgatccgcggaaggcaataggattcatgaaacgaagaataggtgtgttccaaagcatcctgtatagtcgccgtggtcatgaggtcggcaatttgcgccgccgcactcttgttctggcttgcatatccattgtctttaggttcaggtgtttcaaacggctgtgcaattggctcaactgaacgaatgcgtctggtgacaatggtctcgtgaccagagggcagctggcactcttccagcgtgcgtgggatatcaaggatgatgatacccttgtccgggctgctgtaccgaatagaagtcgggcggctactaagatttcggctgtccatcggttcccgagggcccagaagcaccacaaatctcggttccgatcgaaaaaggcgagtcattgggagaaggtcgcatcaggaattcaatcgcatgccaagtgctatatccgatggctgactaagtcaactacgacaaagaatcgcggctatatactgtcacggctattaagatctctatggtaatgtgcaacatgccactttggcgcaatacgttttatactcgaggttgactctcaagatgcctgaaatcctcatgatcccggcattccagaattgaaagccgcacgcagataatgagggcttcctgcggaatcgcaaggcttaagttctagactcggcaaacctcggttagtgagggcctctccacaccctgtcccttgggccatgggatgtgggcctggaacagcgaacactaccactaaaaagccttggggattaatcagttgcccgcatgacgttctgtaggagctgaaacccccaagttttcttgcgtccggagatcaactttggctgcaccccgcaaaccctacctacgcagcctcactggggcttccgttctttttcccgttacctccgggccgtcgtcctttgtttcctacgccctcatccaccgttcccaagcaaggagtgcttggagcgctacgactagacatcttcctcaccttcactacgattcgaccagtcttcgcagcgagtttaccccatttcaaagaccacctagaccgcgcccacgtgccggcaacctttttgtcctcatgagccatgctgcatctatcgcggaggtgaaccctgcggacgccccaaggcatcacgcgagtacgaccgcgagcaaaaagaatgcgcagattatacagcatgtcgacagccatggcgcaaccgacgccgcaatccgcaagcagacgaggagcttggattatatatggcgatcaggagtagcgggaggcctcgcaggctgtgcggtacgtggatagagctggcgatttcatggcatcatactgatatgatcttacttaggccaaaaccctcgttgcgcccctcgatcgggtaaagattctcttccaggcgagcaatcctcagttcgcgaaatacacgggctcctggttcggcgtggccacggctatgaaagacatctaccaccaagatggatcccgaggtctcttccgaggccactcagcgactctccttcgtatattcccatatgccgccatcaaattcctggcgtacgaacaaattcggtccatcatcatcccgagccacaagcatgaaacatccctgagaaggctattaagtggaagcctggccggagtcacctctgtcttcttcacataccctctagaagttattagagtccgattggctttcgagacgaagaaggacagccggtcatcgctgtcttccatatgtcgagatatatacaacgagcagcccgttcataaaggtgcagcggcaagactgccccacgctccagagccaattgccgctgcagcagagaaactccaagccgtaacccccagggttggcatcatcaacttttaccgcggattcttgccaactcttttgggtatgcttccgtatgctggcatatccttcctcacacacgatacggtcagcgacatgctgcgatccccatcgctagcccaatacaccactctaccgaagaagtcgacacacccgaccaacaagccagcaccccttcgctcgtgggccgaactgacagcaggaggcgttgccggtctgttgtctcagacagcctcttacccgctcgaggttattcgaaggcgcatgcaagtgagcggtgcagtcggcgatggacgccgcctcagaatctctgaaacggccgccatgatcttccgggaaagaggcttccagggattctttgtgggattgacaattggctacgtcaaggttatcccaatgacagccgtcgcgttcttcacgtacgaaagaatgaagctggctcttggcatctagaattacaggcaaagaaaaggagttttggcgtcgttgcattggaaggtttatggcatggcatttgtcatttttttttttttttggatatggttcagcatagaagggttcacacgtgtattagagtaaattccatatcattatgattaggctgggttgtatatgtttacccactggtacgccagtgtgtatgcgatggaggcgttttgagggctattgagctccttttgtcaaacaaggcaccctgtttgacgaaaaggtttcttgttcatatttgtaggtatgcgaccgtcacccgaagcatatcaatatacattaagcctacattatgcattatgcttcgtgactactaggtaggatcgtgtgcttcaagccaccaatatcatcatagcgccaacgcaccacaacttagatgttgacctcatatcgacctctgcagcccagaagaagaaaagacgcggttttcttgctatgctatactttcacaaactaaatatttttattgtcaatacctagcgcacgccgagcttgatgaagctctagtcattattcaaaatgaacaagaatacacattgagcatgactagagagtcaattagtacaaacgtcgtactagcttgttttttttctctctctgaacttcttctgatgtgtatcatctcttatttttcttcatttttatcaacaactaagcaggtggtataagagtgtgccgcaccttctaatcacgcttcagtaagagttagaacccagcatgattaaaactttagttgcccaaaacaatcataacaccgagaaaaaaaacgtgaacttacaaattgtcttactatcccaattgtttattgtgccattaattctatagaccagtcactttccaacgtcacagagccgagcttgatcaggcacacttaccgggggagcgtgtccgctgattggtccagccctgccaccctcgctagtagatccagttacctgcagcagctcgaaagcttccatcctaaaaaaacgacatctcaccatcacgactcgactcgacccagcctgactctctatcccgtacagagacacgcgcgcgctcgctggcaggcgctcattctcataaagctcgaggcatcctccttcccgtctatatccaacccgacggaatactagaggcgttcaccatggccgactacgacccgctcgtgcttctgcgacagtccatctcgggcagcaaaccctttgtcccaagcgcgtccaccgacccagcttcacccgaagtcgagcttgctcaagcgacacatctggcattccccgagcaaggtgtagctctaccgttctctacatcaacgcgcttcgcctccaatgatcagtctgtggatctgcgcagtatctacttcgcgtggctgaaccgcgaacgcgctatccctgagtacaatgctgccgcaacagctttgaatgatagcctcggtgctggtggcaaggtccaaaacttgggtttcatcgagagactcgacttgatcacatggctcgagggagccagcgaagaaagtgaatacatcaagcctttggcaggggacaaggacggatcggctgtggccgagggtggtgccgccgctgcctccaagaccggcgctcagtcttcagctacccaggcgcggtcaggaaaagggacattagatcccaagctcgcgagtgtctacaatggtgagcgacggatgggagatcgcaacaccgtgctcagaggcatcaaaccaaccgtaagttgaaacagagcatctacctattatggatagctttccacatataggatcgccatgttctaaccttggcttatcgaaactaggacttctctcatgttcggaaactcgcggcgccattcctcgccaagaaggccccatctgctcatattaacaatacgcagagcatagcacttaatcaaaagacgccgtctagaagaccgaatcccattattttgctatcaccctctgcgtcggccctcattcgtctatccaatgcccgttctttcctgatggagggcaagtttagcccaccagacactggctcctccaacagcaacatgctacagatcgaacgcagtatccctagcgttgacccagcacgcctaacgcgcttcatcctggtagagggcccggagcagttcaagcccgagtactggaaccgcgttgtggctgtcttcacgactggtcagacatggcagttcaagaactacaaatggagcaaccccaacgagctcttcaagcacacgctgggcatctatgtcggctggcgtgacgaccaaccccccgataacgtccggggctggggccaccgcgtagtttctacaggcgtcgaccgatggaggggcgagggtcatgaggacacccgctttagggacaaggaggtcgtggagcagatttggaagtcaattgagctcaacatgtctcaaaaggggtggaggaaagatgctgccccaagctccatctagctgcatacatgccacccggcgaaaccaagctgtaaagccttggtctagagtgagcaccaaggcttgcggatgctaaaatgtggttgatggaactttctacttgttctatacatgatgaccactgtttctgagtggactttcataaaagcgaaggcgtttcttgggtttatctgttttgtttccttgggcttggcttactgtaattggacgatcctacagggaggaaacgcgagggcgagagcgaacccgaaggagagagataacaaggaaaatttttactcgttcatcattccgtggataatgcaaaatgacaacttgtggtggtctagactactcgcgtgacagggtcgaccgtacgctgacagcaggcggccctatccacaaaaccaagtctcatatatacatgtattattatttgcgatttctagaacaccacagcgaggccaagcaatccaatatcatactctattaggaaggggagtgtgcaaggaaaatccaggctcccgtgcatccgggacgggagagtcaaccagctggcaggtatattaatacatcatcccatggaaccgaactgaaacgccgtggagcaaggcgctgcgacgcgccgcgacccaagggcttggatactctgtatcatgctgttctaaatgagccacttttttcgtatttcagcgcaattgcatattccggtgctgtctcgtttcacatcctcttgctggttcccaatccagcaaaagagcccaatgaggctgaacattgggggccaagatccctgaccgggggggggacccagtacaaatgtaggtacaatccggtgcgggttcgagttccacgactttccctggcttcccgcacggtggaagggaaaagttggaccaggcgaaaatcgcgggaacttggtcccgcgggtgggcattgattgacaattttccaccgcgcgctcgggctagaaaacggaaggattccttctggaagggtttctaatttcactgggcccctcttgcaatatcctccatgatggtctcgggcgatgcctggcgctctgtcacggaactagtgccaggaaatcaaacggtgtttcggcacttgatccccttggaggaatgcgtgaacccgagtgggcacacgtgacagtaatatgggatgaggtcagatcatggacaggatcactgactggtcgtctgaaacggggctggacccgcctcagagacaacgtgaatgtaattacctttagggctcctgtggtattattgtattgggtactctgcatgaaatcctcaataatcccaatacgagtgttgaaacaccgtgcacttggtctgtgacgagaccaagaataggtccacaggcccggcgctgtctccgtccatgttttggaagtgtttgacattactgaagcaattcttttggtgaactgcgattgggacggatccccttctaggagtagtactgcactaatacaacaaacgtgcctatgtcagagtgacgggatcagcgggcgaacccccccctccgtccatatcataggctgcctcaaccagagctcccagaagtcaatcaactatcgcaaggatcagggtacaactctgcctcatcatgccgccctcacgccagattgacttgctcaatcggtaacgtggccatgcaccggcagggcagggcgggttttggataatgcagcagacatgtgcgctgccggaaccgccagttcaccaacctgggccacggcgggtctcgtctcttgcttggccttcacgcggcctcgctttttgcaggacatatgcctctgtactggtccctccctcgtcaagccggatgtacataatacatgtaggtatcatgcaccgtctttctcgaccccttggggccctccgggaggggtaggctcgtagagcacaacgggacaagagggagagggcgaatggaaggccgcccatctccacttccactggcacggaaagtatgtgagcgcacgaggaaataacgcggtggggattttctgcagagagatgtgcccgcgatgaacactcacgaagtgggaataccgacggaagccaagcgggcacctctccatcctcgcccgctgttggtctggcctggtcctctggcaggaaaggcggcgagcaggcagcgaagcgcaacaggtgggcgcctccaagctcaagttatttttttttcttcgcttcgagagccttccgcggcaggcggcatgactgcattccattgatgccgttgcatttcccgccatgcaaccatgttcgctccagcggcagcggcatggattagggctctcggcctcacagagaaggtgcagcacgaatgccgagaggttgcgttataccccacgagcccatccaatatctttccggatcaaggacgggatagctgtcaatattgggtgcgtgccgtgtcaatcgacggtataatacaacttgtattatgagccataggctgaatccggatggcatgatcaatgggcgatgccttccttgctgatggtggtgatgtccccccgccattcccccccccctcccacatggctgcgagatgtgcgtctccgacgatgtgaacatcggctgagttacgtgcacattttcatgccggcagacggggtcgcgttggcatatggactgctcctcatttgcaattgagtaatttcagttgcatcgcattgcaccgcgttgcaccgcgttgcaccgaggaggccgtgcgaggggagggggagatgcatgggaagatacttagggtagaagcatagaccatctgcaacgctcttctgcggcctctcaacggcttagcataccgatatacccccccctccaagcctgtgctacatgatcgagatagatatccatcatcattgggcgggaaagggcacggcagacgggctccaggaggcccccgggaaaggcgacagtcgcttccctcggatgagctggacgttgggacgttgaccgaagcctatgtccgtagggtatactccaggcaggatgtggggagggggcggtgatgagaaatcaagcagcggacgtgactaacatgcatgcatgtaggtacgagcacacagataggcagatgggtgctgatctccagatgtgaaggtgtcctccctgcctggctgccatgcgacgatgccatgctatcatggcacgagcagctgcagaccgactaactcggatcatagcttcaagctcctacgccaattaacgatggaggttgcgattgagtggaccgctcttgaacacaagagcctgggccattctcaccaatcacatgtatcaacccgcggctaggtcgtgagacggcagcgatctatgctgtcagggttacagaccgaccacggagctaggccgggacggttttgacgccggagcagcgaccttgttgtaaggcctccacgtgcttgtttgggagtcgtgatagtctgatcgatgcagcaaccccccccgaaacgaaagaagaacaaggaacccagcccctccccttccgtatcgttactccctcctcccccccccatccatttcgcttcctggtccaggcaaaccggtcacctcgcttggatgcacaaggtccaccaaactagctaagaggccaccttgggctcgactagtccgggtccccaattgaatagctcgcgagcggatgacacatttgccttctggcaaggccaagccagatcacagatgggctcaggaaccaacggaagcgggccaagggcgcaacctgcagctcaacgtccgagacgcctgggccatgcgctgggtgtgggatcatgggttatgaggatatgcgggtacgcaaacagagcccctcccctcttccccccgttatagatgtctgtctagcattccatttggtccaagcacagaggagaaacccactaaagtaaatggcgggccggattatatgatccctacaaccgcatattaatggcctctactaagcatctctatctgtccccttctccctccttacatacataaaacctatggtaggtatacaacagacatgcttgtagtgaggggcttctgcccgctcgatacccccctgttcccggacaggtttgtcacggccctggccttatctaagccatccagaggaaaccagcttaggaccatgtaggtaatcaagtagtgccagccagtccgagacagaccgactttgatacgagcaaacgagggcagccatatctcgcgccacaagggccaccagagcacaagtcgtcgtcttcctagccccagtgccgaaagggtgtgctgtctccccaatgcccttgctgctggttcctgtcacttttgcgggacttgcaaagaacaggttgctccaaatttggggagggggtttgccaaaacggagccaggaccgcgtggtaaggcgcaccttaaggtaggcttaggcaagccttcggcaatggtgccctaccgagatggctggttcgctggagcgtttgagcggtggatcccgctggggggggggggaccagacggcttgcttgcacatggcaaagtactctgtactctcctacacccctggccatctctatggggtggccgctctgcgcttcgggcaatattgtgtaggtacctagacctgccaacctgctctgcctggcgctttgggatgccactgtctgaacggcggtatgtatgcttttacctggcattgcttgtaaacgcatgtgtctgtgtgtacaggaccgctgactgcaaccatctggatgcacacacatgcattatgatggggttctgggcaaggacaagggtctctcccaccaacaagtctgagagtttttttcggcagtccgcactggcacacccgtgccacgttaatgtcgctcatcacgggacaaaggcacatggtggagcatctagtgtgataaaaaagaggggagaggggaggagaggaaggtgaaggttacggagagccaccaaggaggctttagcatgagggggaggtgaaatggcggtatagtcgcgatgataccgtgcccactggcacacgcgctgacaggtgtccatgggtccatggaagctccggctagcctttggtgcttgccgctgtcaccaggtaattcactatggatcgtgatcctgtcccgaataaatttacggcttcgttaccaggtcgccggggcaggcaatgccaccatgaaacgcagaaaatcgatcctaatagtttcggtcagcatcatgttgggcggtctgtgccccggaagggcaaattaggtatcgcgataatattcgggcattgctgtggtatagcagccgcacatggcggccgccgtggagagggataatcgcaatcgttgccgtctcacctgctctacgcgagcccagggcgcgagaaaagaaaccgtgcacaagcctcttcaccaccaacatgcgggtggcgggcggtggagcaatttccatccaggtcgagctgaatagtcggtaaatcatccacaccgttcgtgaacgagcgaatggggcggatcacgaccggattggtcaagggcatgtcgcttcaatctcatcacaatgtgctgttcctcacatgtgattgatttgcttcccacaatgtatacaacgtagggggggaaggacaaaaaacggtgaaatgaaacggctacgctctgcattacagccgctcagcagggagacaagggcgacgttcgggaggcacccaaaggccctcttttttgtctctgattccatggctggtgtagccccaatatcagggcaggtcccggccctttgccatgtggcattgtttggggaacgggcgccagcatctcttggcctgcgctgacttgtttcctgctcggtctcgtacgatgcttgagtcgtgacggggcgaaattggcagagaggacccgtcattcaatgctaatcatcagtacctacataacctcaagccactgtaatgctatatatcgctgccacgggtgcatatgtacgcgtataacggaagcaagcatacatttggggtggtggtctatcgacaacggcccttgatgaggtggacctattgggtcatcagcagatacgcagactccatccagcgcccccaatatagcaatcaaaattacacgaagaaaaagaaaagaagaaaaagtaaaacgagcagcaaatctaaaaaagggttcagctgagaggcgtgacatccgagccccatggaaatagaccgcctcagctaagtgccgtgtggaaataacgtcgccactgcgccaggaccctgccatgatgatgcgatgcgaaattctaggccatttgcatcagcgccaacccttagttagtatggggaagggctctggctcagcagcggattgatagatagtagcgatgatcatggtacaatttggaaatagcaccgcgattgcagggtaggcggtagacccagtcgggttgctgatcccttgggaacaacaaacagcactgcgggatcgacgggcgccgattgatagaatcgcggtgccgagctggtggtgaaatggcatggcaggcatccgacgcctactgagtcactgcatggctttgattcgagccccgggcctgcaactgcgtcaacctgagatgagttggatgatcatgctcttgtgcccttccccaccgctctcgcgtctggaaacgcgtggctcttcaaatccacgtggcaggccccacctacggacggtactattcttaaagccattttcgtccaaaaagagaggccttggctcagcttctacacccacgcccttacacaccacaccacaccccggggctatcccacgcgcgcagcctctgaccactgccagcagaagccggtgtgcactacgagcgctggaacaggcaattgatgggatacagggccagccagaccagaccagaccaggacagggtatttacttagcattgccatgccttgctacagtggcgccttcgcctatcacccagtccccccagactcccagctcgaggcggtcaatcaaaaagtctccctgccacgtgggagcgcagagcacgctgtctcctggtcatgggcaccttggatggataggcccccctcccaaaccacctggagcaatgcgatatccaacaacaaaccggaccttgcttgcaaggcttcaattgtcagcatcaccacattcgttgtgtcggaccttactttcccgtcgctgtgtgaagcttttacctaaatcccttccgcattgctcaacctgcctggggacggaccgtatcccacaaaacaacatatgcaactaagcgggtggacccagatcgcagtagcggatgtcctcgcaactttgctcttgtagggcaggtgtagttgaaacttgggtacatggagtctgccctgtgttagcgctatggtccatgtacatagcgggatccttttaaccgacaccctgccgggtttacatgggaatgggggatgatctcctattgtacattccattcgccatgagacggtctgcactagcatcaactagtgcgagaaaaatctcctcacaaatgggtctttggaactcagattccacttccgctttcatctacctgcatggatagatatccgggaggcagggagtggatggaaatttgactggcccggagcagatgcgtggatgggaaaaaaaggaaagtgagcattgatccaggaccgagaggaaaaaaaagcaaaaccagccgtgtaacgttggggcgggctcacgcatgcacccagtcatcagccaaagggtaccccgtctgtcagcctggttcgttgatgggttttggggcccaggcccaaggccagccagccagctgcacggaaagcaagatactgggacggaaggcctgcctgcctaatgtacgacctgcatattcggcgcctcctcttgcttccccccgaagcatggttttcaagccacgcagcacacgcccgaatgctggctccctgcgtcattgcccaccccaggacctgcgggaggggccgcatgtcggataatcaggacactgccagcagacgacaagaactcgcattgaacgaggagcgctgcgagaatgcaaggttacagctggcgacgtgtgtttggaatagcgccgaagttctctcttgctctacccacagcaatggaacgtagaggagggagcacaggggaggtggcatcggccgaaacggcgttaggcaccgtattactgggcgggcttggttccgctaccgtagacccatcttgtacacatctggtgtggatgtgttctgagcgctgagaaccatccagtgcgagaaaacttgacatgggtcgtatccggtgctgtcctcatggttgtcctccgaaaaggggtagagaggggcagcctcttggacggggcgggaggggagcctgccagcccattgaggaggcatgctccttttgggttcttgggactccgaaagggatggaatttcctgccaggctcgagatacctacgtacaatatcctgcgtacccggtaagcaccttacctgacaaacccatattaatagcaaaatcccgtgtaggacggacggaatcaccactgccacatggcttgccctgggtgttcgctccctgctgccggggaatgttctgccgctagttcttttcccttcagcgggctattacataacgcctctcgctctgcctaccttgtagttcacaagaccaaccctgactgtggtctgtatagcgtcctcttgggacatgcctccctgaaagtgagcatccactagccaaagccttgctgtgagacattcttgttctttgttcccgtcatctctattccccggctcccatgccatctaggtggccagaatgacgtgttggcctcttgccacgaaaatagacatctacagatcatgcatgtagttcgtgaggcgaggagatctgcgaagcacgccggctggatgatgtaataaaaccagggatttgatagacaactggatggctacagcagcgttggctgactacaattcacccgttagtagccgccgtcgacgagaccctggccatttcatcttgtgtgacatccgccgccagcggaataccacggcggagcaaagtcgcaccgctgtggttagacagccagtgctcatagagctggcccaagcatcgcacacaggccacggcaggccctgccaaatgggcaataacacggcatctacggcctgaaagcgccgtcgagttgagacaataggggtattgccgatcgaggtggggatatatgcaactaacctagcgaaaaagcccattaaacaacaggttgattccggcaggcagaaaaggggaaaatggcggttagaattgccagaatcgccatcgcagggcgagcacaacgacccatggcagatcagccaatcccatgctgaatgccgtgatctctgcccttgccaaccaacactcacacacacacacacacgtacagcctcgccgcaaccttctagaaggggtccgcaacaccggtcatctgggagttgaaacgctgctgaccacaaggcgagggtctgtgtgaggcatggtatattctaccatgggatgggccaatgcgatctcgtgttccatacccaaaaccgctattgagttgtcaagaggttcgagctagagaatgttgtccgcggaaccgacaccgtcaaacgacaggttctaccgcgtgttgttgcccatacataggatccgttccctgctttgtccgccaccgtcgccgacgccaccttttggatgctgcatctcttagtcggctgagttattgaagtggtgatgcacaaggttcaacgtttcggttccgaatgtaactctctaccaacgcccagtggcgtagcgtccacctcctccatgtttagcgcttcttttagcatcacggagaaaaaaaaatctcttcgctacgggcctacagggagacgggggatatttttccttctcctaattgctgtttttccattttattcccatctttgtttcctggaggtggcgctgggggcagccgggcactattcttggatgggttcaccgtttgttgcacggctgggctccggcgcacggcgcaaagtgaaaatacctactatgtacgtacatggccagtggcttgaacgtcaccagacagcttattcccatctctgtgacggcatcgccgaagggcgaatgttccaacaagcttcggcgagggatcattagaactcataccccggggtacgctgtttatccgtcgtcgggtttctgccacatgttagggctgtccgtttccctggtcagcttcaacacgagatcaaacattcatgggacggcacccctagagtgatatcaggggtggtggttcagacatggctgagatgacccctttcagctgtctcggtctcttattggcaacgagacaagatgagggtttctcttttgtatgttgggccgaaatgacggatatggtggtgtagtaatcagcagagggtggtggtcctgaggatttccggatatgagcgacgcttattatcatttgcaacacaaggtttgcacatggtaagcaggggagacaggggttgatgggagggatggagcgacgtgcgtgggagagagcggggagatgacgagccgggtcttggcccaaggagcgagaggcgagaaggccttggcccagcgcctgtgcccaccagcaggcaggtaggtacctcgctacaggtgtcggtgggctggcagccagcaccctgggcgtaggcggtttagcgttaatgcacagcgctgcatggccgcaacgtgattgtcgcaggacggtcacactaaaagtcacgccgccgatctctagtgagacttccaccacgaggaactgcagcaggtagcgcaatgcatgtatgcgatattggacaagcccatatctgccgtccgggttttggtgcgggtaccgtctacctgcaggcccagcctgaactgctctggagctagagagcctcgcgcgtctcgagctaagccgggtgcatgcaagaaggatggagcggaaacacgataggcgaatattctcaattattgttctgccacccgaacatttctgtcatagagcagtgctctttgccaagcgactatcttttgccaccaacgcagaccaagactggtatcattttctttgtgcaggcgcctatcgccagttagggtgttcccatgcgaggctggagtcgtgggcatggaggatgttaatggacctggcgatggggttcgcatgaacaagagtaccttcctacggcagagcgcacaggctcgcggacagctcgatccccaagatttgaccagtcggcgtttacagggggatcagttgttgtctctctcgtatcattgtctggcggccttgcttcatgcctcgctcatggcttgtctgcgggttaatttttcttttctccatcgaagcattttccccttgaccatctggggctctgccaggacaagtcttcttggcagtgtctcacggtccttccgcacttctgtgcccttatgccatgctgaatctaagcgagcggtccgttgtagcgtgctccggccgtggctgctcgcaaacacaggccatctgtagcttacggctctgatcctcgcgttctacggagagattgaaggcaatgaaagcaccggccagcggcatggctctactgacaggtcgcatgagaattcgccgctggatgcaataaaagagagatttagtgattaattgagctgataataggaccttccgctgagcagtcggacatgctgcaatggcgagcctctgtttcatcttgggccaatagttggagccaggccagggctgcctctgtgaggtggccgtagacctacagagagcgtacagccgcctcgctaggtaggtggctcaggcccgctggcgcccccttagttgcaatgccccgccctgaaccccacgccaaaggtgacggtgcaaggtgcctgacattcgccagcaggtagcccagccctggtccttcttgggggcttccaggccccctgtcgcagctaaaggtattcgctacctctcggaccatggcccccctgcctggtctcagttcttgaggctttggctaccttattacctacagccccgactaaaccactccagtcactacaccgcacccccctgggtggtctctgagcccacccctgcgctccccttctacaaccccccctacccacctccatgagtcctcatctgagtgcctgagcagtgcattctttctcgcctttgtgctccccagttccctcccagtgctcgctctcttcatacaagctagcccactcacactaaaaaaaccacgccttttctctttcattctagatctgccttttaatcaaatcaacctccccgcctcccaagattcctctgagctccttcccctccctttaaaccacctttcccccaagcccgttagatggccgcattgcaccagacttcgatccccgagccactgtcactactatctggtcacccccaaacaccaacgcctcctctctcacccattgagaagttaccgccaacccctccggccgactcctcgaccgtggatcggaagccaaccgactctgtcatcgctggatctcactacgcccattccgtccgacaccacagctccccgtctacgagttcgatatcgagagcgccgcaccgctcctccagtggcatcctctcctccttggccgctgccgctcttgacaagacccagagcgctctcgccaacatctccgaccccgtcatccgccagaggaattccttcgctcgcctctccctcagccaaagctcaatcccgctcagcgaccccgacagcccggacaagaagtcgcttctgaggaagccctctacccagtcgctttccaccaaagccaccgtggacggcaagcagcctgcttcagctgccccggccaaagtgccgatctcacagccttactctgaaactgacccaagccggccgcttcctcaccggtctccggtcaccaacaacacaatgcatcaaacatcctcgcggttactgcgcatgacggatgatgagcgcccgttcacaagagtacgtatttttaatttcctggccccccccctactgctcactctcccataagtctttttttgtctgcgacgagagcagatatggtgagagaagcgccattgagctctgtgctcccttttgcagcaaggaagccctcaattgagcccaactcttttacagaggggccaacgagggtatccgggttggtgggatggatggtttggatcaggcgacgggggggcccctcagaccgcaagacgataaacttgagacacaaattgacttacaactctgcaggacttcaaggatctcttctccacactcatcgttagcttacttcctctcggtgcgcatcgtgttcgattgaccaaggtggactacacattcctctctgaagatgctatcagcaacctcaattctctcaagttctcccaaagcaaccgaatgccggaccccaaagatccatcacgaatcgttacaacgacgactacaactaccttttctatggcaaaagatatggcacggtcgatctgccagcgatttctcgaggctcgcttcatcgagagtgcagatggaaaataccaacaagtctacaacatgaaaggaggaatctggcaactaactgctaagggagtcaccgtgctggataggttctgctcgagaaatggcattcaacaaaagcaggttgcagagttggtgagccgcagtgcggctcacctcgttatcttggagagaagccagcacaccgacaagttggtgactgacagaagcaccctcgatgtcatcttccgccggtttgttggcacagacggtcgaaacatcaagtcgagcgtgacggcagccgactccgactcacttcatgactacaaggatggcttgactggagtcaaaatggcagccgagcgcaaggtgaacggcaagacataccgggagaccatgaccggcaaagctgtttctgactggttgatggactgctccactatcgttgatcgtagagagacgatcgaagttgctaccctgttcgttgagaacgagctgctcgaacctgttgcccaggatcgctccttcatgtctcaaaacccaggctgcaacttgttccagcccacaaagtacgccatctaccaaatcacacaacatggaaaggacgtcatcaacggaaccagcacccgtggccgtcaatcagaaagcgaaggtggaaaccctacacctcgcaatggcatcaaccgagactccaacacccagcgtctcgacaagatcctcactgatgcagctctgcgtctactcttccgcgagtatcttcgtgacacccactgcgaggagaacttgtcattctacatggatgtagatgactttgtccgttcttgcaaggcggctattcgccatgcgctcaagacccaaccccctgcaggcaagaatgcgacgcagggcgctccccaaagcaatgcgtcgatggacagcgtcaaggaaatcatggcccaggcctatggtatttacaatgcctttttggcccctggctctccctgcgagctgaacattgaccatcagcttcgcaacaacctggcaacgaggatgaccaaggccgttggtcaggatgtcaccatgattgaaacacttcaggaggtgacggaattgttcgaggacgcccaaaatgccgttttcaagctgatggctagcgtaagtttctatcacccgccgcaaccgttttttacgatgttgctacggggctgactgctaacaatttgtttttttaggactccgttcccaagttcctccgcagcccgaagtacgagcagcagctccgtaactacgaattcgacaacatgggccgtgtgcctgagcgcagccagagtcgctcaaaccgaaactaagcgacgttcgcactcagttatagagaacaccatctaccgctaagccattttcagctggcaatcaacgacacgcatgatgaccttttccttttcaacccattgtgttgcccttagaccatacccgtggcgagtggatctggctctccggacgagcacgaaaacacacttttcatccctgacaaatatcagggagccaagccgtgctctaatccaagcgaggcatccgaggaagcctgctgtgaacgggctcagcatgcaaatgcaaaccattttgctcccaccaccggacatctgtacgacatggacgaccaaaccataatagattccctcgctttatctatcatgtgcatcattggtgttgtttgtttttattttattttatttctatttctcttcatctcgaatttatttttcttttgcttcatgtcttggtgcttgaagcaacctctcacggcagccaagaaggacgggaccggctcaaccgacctcacgaggccgttgccggcaccgagtcttgtgcaccgtgcagatctaattgcctaagttgcattttcatattgttttgaggaattatggagggcggcttagttttagggcgttggctggaacgctggaatagagaggaccgggtagtacctgaggattcttccgctcgtttgcagtacaaagcagacgaggaaaaaaagggaggcaaataattggattgagagttggagcctgaaagcaaagcaagtcttattttagtgggaagcagaaagcccgtgtggcccggatagagctggattgcgcagaacggacggagaatgactactagagctgaactgtacagtattgccaagggagcttgtttattacggccggcagtgatatcccgatctttttgctcttggggacccaacccgcacgtccgtcacgattggctgaggaggaatctttcaccacaatgggacagtgagacagttgccgtgatatgggaagatcaaagcggaagatgacgaaattctcaactttgaagcatctgtacttagtagaagtgggcacctcatcacaatcgagaagaaaattggatcaatcgaaatgaaagctgtgcaagtaggaatgaagctcgacctggagaccgagagattgggggcaggtctcaatggcattggcacgctgggcaatctggcgatggtggtttggaatgacgggaataggaatgcgacggagatcaacacagctcaattgagctgaaccaggaacagaaccagtctaggcctggcgatggatgtggatgggatggatctcacaacacagcgctgctttcacctacgggtctgtgtttgttttcagacgtgttcgtgactccggcgtcttcgcgccctcgacgaccggaaacagcatataagaccacaagctgctctgcactcagaagcatgtctttcattcattatcaccatcttacccaaccggttcttctctacactcgttcatacaccgacgtcttaatttcgaatctctttgattccagccactcgctcaaccaaatcaccgttctcacccaagacctaatttcataatgcacgcccaagccttcctctctctcgccctcgccggcctcgctcttgccgccccccaggccggccctcaaggacctcgtcctaccccggacgccaactggaactggggaggggagcaccacaacaagaccatcaccaccaccaagaccctcacggcctacaccacctactgcccgggacctaccaccctccacttcaacggcaagaagtacaccgtgacccaggagaccaccctcaccatcaccgactgcccctgcaccgtcgtcgagactcaccctcccacccacaggcctcaccaccccacgaccggcggcccattgcctccccccaagaccacgggaagcgcctcgccacctccccagaccggctctgctcctcctccatctcagcccactgccaacccaccggtcaacaacaacagtcctccctcgacccctaacacccccaacacccccaaccctcccatgaaggtctccggcgccgagggcagcaacgccaagttcggcctcgccgtcgccgccggtgctgccatcgccggtctcatggccctctaatcgggtcccagcccaggtccccgcgctggcgggtgtcccaggtcgtcgcccttctgtggccacggccgcttcttactttctttcccagggctctctcgctgagtcggatccctggtacttgatacttttcttcttctctttgttgattccttcttctttccacgaggggcgttgtttttttttaacatttctgatgtgggccggtctcaagctggtataatgatttcttcttcctccttcttggagttggtgacgtttaatgggtttaatttcctctgctttcgatagatgggttttttttggtttttttttgtatgtaacttatgaccgcatatttggtgttgtcgtatagctcctttcatacatcaccttgagcaaaggtggaatacaaagcttttcttcgctctactcgtgttgtacctcgctcgctatggtgacccctcgagctttcatcgttcgaatcttcacagtggattggtggtgcagtgtcaaccccttcctttcagcgtgcctgtatcttgttgtcgcccgttgcgtccagctcggagaacaacacgggtgcgtgagccctgttctggacgtcgggtggtgccgcccacggaggaggggcccgttggaacgcagcagcagcatttgggatgccgccctcgtcccggccaccaccgtattgggcgccgccgtgctgctgctgttggttcaccccgaacggcgcagcagcaccagcaccaccactgcctactgctgaatatgttccagcaccggcatggggagcagatcccagcgacgcagcagggggtccgccgactgccagagccttgcgtcccatggcctcgacgacggtgccgtgcgccttgctcagcgtcttcctgacgaagccggccatgaggaagttgcagcggaagtcgatgtcctcacgtatgtacagtcccgtggcgggagcgcccagcccgagctcctgcgtctcgggcggctcgtgggggaggcgccctcccaccgaccacctctcgcggaggtcgagccccatgggcgcgtggcagtgggtctgcagcccgtcggagaggttgtggaaggcggcggtgtaggagacctcgccggagaggaggtccgacccggggatgtaggagatcttgtcggtgatggagtaccaggcgcagctgtgctcgtcgggctcggcgtggtcgggggcggggatggcgtggcgctcgatgacgagggggttgaggtcgatcatctcgagatggttgtgcaggaagtcgagggcggtctcgcgcgacaccgaggccggcagcggggagatgtttgtgaacgtggtgcgcttcagcatgatgggcgggttttgggtgtcacgacccgatgacggaggtgaggctgcttggactgggtgctgcggcagagtttagagatgtttattctgccttccttgggcaggatagggatagagaagtggcgggttccagctcttttctgctcaatcgccagctaacgatgtatccggcgagtctgggttacgaaggcgggcggccgttgggatatatggcggcgtctggggagggagcttgggcttggggctagtctgtctcagcctgtagggttgcatggacgtgagttgtctgtcgatcaatagtgacccagctaattcgtgcggagggtgaactgcaggcgagaccagcgtgcaaccgccatgaggctgatgaagctaaaaccgatatatattcactaacgtttctcgaatcgcctcggtcagcgccgtcctgttccaagtcggcgctagcatccgctttggggtgacgatgatcccaagaatagctctagcatcgcttaatcatgctctgagcataagccacattctcacccgcctccgacgtggtgtttgctgactgtgagcaacggaggtccgccctcagggacgaatgatgagagatcaggttgccggatatccagttgacccctaccctgatctgttgtgtgaatttcctaattgaatgtattcgcccccttcagctgactatagccggcgggtgttttgtctaactagtatatcatgtctttgaatacgctctcacacagcacgtctatataaagttttcaatcataaccacataggcctctttacagctccttgcaccacttggtctggaccgtactgagtttcacagcccagggaatctcctccagggccacatccagcttccacattcttccttccaagccaccatggctcatcgctttccctccaccgaccgctgacggcaccagtaaccctaatgtgattaacctttcccaggcgattccggcaatgcctctgctccagacacccaccccaccaccaaccgcaagcattcccgaagcggccgactgcacacgctgtctgcccaccagcgagctgtactcgtcgtaagccatggcaaagttgaccgtgtcagtgtgtgccacaatgtccagtcgtgccgccgctattaccaggctcagttccaaatctgagagtgctgagaggaggtgcatccgcgagtccggcggtgctaatgatgtaaagtctgcggccacggctggcgtatcaatgaccaggttggcgctcgatagtagcgacagggggagaacccagtcgttgaagaacgccgccgcagacttggtcgtatagtaatggtactggagtagttcttggaatgctttctgcttatataattcctgctcaaatattaataattgcgcccacggccaggaaggaaaaagtagacttatgtctttacttacatcaattttctgactccagtacttgtggaactcgccgtagccctctacgttggtgtcaattccttccttctgggcatccttcctctcgacaatgagcccttgtcggcaaacttgccagaaagcgggtaagcttttaggtagcgtgaggtaaatgtaacgatggctgaatcgactcttgactctcttttccagcaattccacgatgtcaagtcgggtagtacatcctaggacggcgatcggagctttacgcgattgcgcaatatcaaacaaattgtagagtagagtttgacgcggatgtgaggcaaacatgtcgaactcatcaagtatgaagacaatggattgtgatgtcagtccctcatccgttcccatgatttctgaaggatgcgagagaagtgccagtaacgaggccatggtgtcggcatagttagtctagaagaggcgatgctgttaaccaatttattcactccaatgaattcaacatgtctgtagcttactctgtttgcaatatcgtcctcgacctgcatctcctttccaagctggcgccagatctctctcagagcaagtttatcgtcagtatgaatgaacccattcaaccttacgacgtggaagtctcgcccgtggtcctttgataaatctgcaatgatgttctccagcaactgctgcatatcagtatgaaattcccagactttcaaaagaagcacatactgttgttttcccactgcccctggcaccgataaggagcatcgagtttccctcgccagcaactacagtctgctcgatgagctggtgcgccttctcgtgtacatcttggagcccaaatatttcaatccgtcgctgacccgtacatcggtctatcaacacccgctgataggaccgcaaatggtggtcgaaattaggaatctcaggtacatcaatcgcttcagcgggtgccgttacaatcgtcgtgggtaccaccgtcgcttctggtcgaggcacgagcgcatcttcctgcgaacacgccttgcacagccagtctccctcagggatctccaggatcccgtagcattcttgatggacagcataatcgcaattttcgcagagaacaatttgattcggtgctttggagtgcggtttgaagcacatcccacagacaatctcattcgtcaccaccggctgtgccttgggcttgcgtgggctcgccgactttttgattggcgatgccttgggtaagtcgtcgaagaagacctcgccatcgattctgttgtcgaatttgacgctctttggcgtctggtttctgttcttcgagggcgtcaggatcgattttggagctggggagtccgcagccgagccaaacagcctcttcccgggcgtctgtttgatcggtgtccccacattgtcgctggtcagctcatcctctgataactcattatctatcgcgtcgcgagtcgtcgctatcttttttacggtcgagcgtggctttgtcggggtatcgtcgagtcgcggctgtctcttcctccctggcgtgcccttgggtgtccctttgggtgtcccctttggtgttcccctgcctcgttgtttcgcgggcgagcccttggatggggatgcaagcaagcgaggcttctcctcattgtcccagattgttccacgaagcgccttcaacttgatcgcagggcgaactgccggcttcggtgcctcattggtgccgctcgaggctgatgggctcgccgctccgttcggcgccgtctgatctgtccggccgaagccaaagtaattggaaattttcgatgtaatcgcattgaaggctccctgggcggacggggattcgttggcggagctgtttagtttgcgcttcttggccgtcgacggggttaccgataaggggtcggcagctcgcttctctccactaggcgttgcattttcctggtttatttctgacatatgggattgattcgagctgtgtagagggtctgttgattagattatggcgtatgttgggtttgttgatcttgccgagtcgccatttcctgggttgctgggattagcaccgggtaggtcgtctaaatttctggtagatcgaccaacgcgtgaagacgcgttaagtgcttaaacccccttctgaggcgcgctatctgtaggtatgatttcactggagccgcttagctaacttgcggtttgaccacacaaccttcctccaaccaagttgccaggaaaaagacagccatacaaaacttgaagcaaggaacgaacagtttatttctcatttatgaacattacaatcgctggttcatttcctcctccaagtctagccttagatatcatcagatggcaagtcgctcctataccatcaacctgattacctactctccctgcggtgtccgtcattggcaggatggtgctacccttcattatcttgtaactcctcactccctcgattgattgtctcctcgcgtagaagagttcccgtacggcttctaccatggtacacacacagtccgcctcgcccaccctgtcgtgattgatttgcaggacataatgggctccctggtaaatgctctgggacatcaaactcaaaggtccccggaactcgggatgtgtctttcttgacaactcggcggggaggttgttcccaccattcacgtggcggggcattcaggctacggcggtgaatgtcactacgtgaaagtgcatggtgtcgagaatgcagcgagtctgtctcaggtcctccatctgtagggggaattgagcaggtaaagaatcctcgaggtttcccgtcagccgtgtcttcgtccagtggcggagtcggtattctttgggcttcctaatcagattttgtttagcaacctagtcaatagttgtgacaaatggcaacgtactccgcctggaaattggttgttgacggagtgcgtgctatctggacattagattagtctatgcgcaatccgtgactctcaataccgcaactcacaatgtgcagtatatccagagactggcgtgcctggaggcgttgagcctcggagaatctccctcacagaactggccacgctactgcaggagtctccagactctttccgatgccaaggggctttgccaaagaaaattttcttggagaacttcgaagttccatgttcatctttaaaccaggaagctgacttactgtttagctgggctagcttatcgatgggaatttggcaacatccttttgcgcctgccgctgtattgtgggctggctacacgcagtcctttagttttcgagtctcgagtattgctttgaactagcttacatcttgatcgacatcatgcttcgctctgaaacgagactcgaaggttttcagagttttcaagtacagctttttcggcgagtaggcagacgtttcggccaaagttggtgatgatttccggataagagtctctgaagatgacttccgtgacagcgtctcttctaagctgtcctcaatgggcggggcgcattccgtcactttaatctcattcagcctactctctcggcgtttgagtgggttttgcagcgagaatacatgggcagactctgtaagatatgggctcattggagttccaggtgcagtttgaaacatctgtttggatgcaggtggaagctgcagtataggctggtcttgtatgtctgcctcacttgtggatttagtagagcgagaccgccatttccagaaacggctgcctgtgcttcctttccggtggaggggcgaggtagatcgctctgcccagtacccatcaggataccagacctactcgaaaccatctcgagctgggcgaggcgggtcaactccaaaggattgtaaaggaggcgttgtaagccgttgaaaggggccagcgcctgtcgatgaattttgaaaggaagatcgagagttagccatcgcccctggccacgaatcatgcgtagctaggccgttggtggtaaaacatataggaggcgtcttggctctaggtggaggagtatggctccgggctaggagcggatcaggtacatcaagctgaaagtagctggaagatgtcagcatttatttaggcggcagaagatctggaaaatggaaatatagcatgcctagaatctccggtaaacggcgttttcgaaggggtcgaccaaggactcaaggaaatcgacattgttactcccgaggagtatgctcaggggcttgtctggatgatcgtcgtgtcgttgttgcccagtcgttgctcccttctcagtggacatcctgatagatagaggccagccgtaggtagttagttacacgaggtaaaataaaaggaaacaaatgtattcataggggaagcgttgcaaagaatattaagttagcgataggatcgacgaacaagcgagagtatttgttgtaagattcaggcatgggcagtcagcactgagagaaccaagtagttaggtaggtagttatctcgagggtaggtgctttccttcctgccaagtctgttctgtcataagtacccaggtaggtacaaggtagctcctgccttgctagagggcaaatagttgggagcgagtgaagctccttgttctcgagtgatttgggcattgaaaatatcattcccctgccaataaagaaggcttggatcattaaagtcaggataaatgcgattgacatctattgaaaaaaagtaaaaagtaaataaataagtaaatatggatgaaccacccagagattctaatactctaggaaggagacgcaatcgtaaatcgtcggctaagaaactccaaacgcccttgatgatgatatcctcgatacattcgtgcctcctttttcctttcctaatccatgatcatggtatcatctccatctagtgccattgctggctgttcaagcggcactcctcgtcctctaccggcgagcagctctcgcctgacctcaggcccaatagcgctgtgaccatggctcagaaggagatccagcagagactcgcgctggtcctcagtgatatctcccttgtatcgttgagcaaaggccagcaagctctggtgccagatcacaggcagcttcgtcctggcatctccctcacgctcgatgccatccatggcgtccccattcctgatcgaggcaggatcgacgcttcggaatcgcaggaagtggaacacgagtgcatcaataacctggtatggaagagcgtacttcttctcgagcaacgtcttgatgaagatgttggttgcgccacctccctcggtgccttgtgaagcctcctgggccgcgatgtcgcaaagacctttgagagcagctgcggaatgaaggacagggatggaaatccttgccaggacagctgagataatgtgtgcctctcggagcgtgcagcttccgctgccaaccagagggaaaaggaagcccttgaagaaagctgcgggcttgtaaagcgccttctttagactgttgaacaaatgtacgttgagcttcttgttctcatagatgtcttctcggaccttttctagaaccacaatttcgaggaatcgctgcacgacatggggcttgctggagacgaatattctcgttgcttggtagcaggcgtttggcgaccagctctcaggccttgtgacttcgatgatttcctcccagtggggaatagtcggtaggattttaaagggttttggtagaggtccggacttatagcgggaaagaatctgaccgaccctacaagaagaagttgttagcacccggaaaaggcatgcgccatgacttgactaatagaagaacatactttgtatagacctccacgacctttggtggcagttcgtactcttcatccggtactccgacggcctttctagcctcgccagcttcgtgctgggcaatcttttccaggatcaaatcagccaggttgatggtctcgctctcttgctcctcgccagttggccggcgatcccagccatgctttaacagatcatcctcatcatctggcatgaacttcttataggtctcaaggtcctcggggtcgacctcgatctcttccacaacctcatcctcgtcgccccaggcctcgtcatcatcgccatagacttggttctcatcctcgggcccgtcctcaaagcgagagtcgtagccaaagctgtcaattgtggcagattggggctgagcccgggtctctgcatcctcctcatccagctggcgaccgatgcgcaagatattcttcgaagctttggaatccacgtagtgctcgtcattctcgtcgcggtccttggactttctcttcccaggcttggttcgcaggacaccagtcgcaatgacatcttcttcaaggggattgtggcgccgaccctggcggccggcggtgggagttgtggcctttggcattatgattttggttgatttactggctataacagcgcaaagacaaattcgagggctgcatacaattctgatatatccggccgattgtgtggcagaattatcaaaaattttgttcttatcgatctgccacccctctttcttatctaggtttagctcggtatatttgtccttttcaccgcctccagggctcctatgggagaggatgaacccttctggtttgtaggtatcctataaagaaattgaagatgttatatatacaattcttttcgtctaaattaaaaaaattatccgagacaaattcttgagatcgaattttccctacaaacatccaagacgcgcccaacacgcctgccacataggggagtctggcatagagtaagccgatttccatctgtttctagcacagaagcctgaggatatcttaaggtaagttcttgaaaaaaatgtccctaggtgaaaatgatagaacaaagtcgataaaattggaagcttgagatcccttgcctgcctccgtgggaacttatgacgctgtaatatccactgaaatgctggtcatctcgccgcctggaatagacccgtaaccccactatgactgacttgccgctgcccctccatctttatcgtaatttataaaacttctgcagagcccgcggcgcacttcctgtgagatacggcaaatcgtcaataacctcccatctgtacatattttgcgtgaaaaaaaaaaacaaagacaataatgcctactgaactagaagaggtgagacagtgcccgagaatactgtccgaggatttcaaagactgatttcaaaatttcaacccagttggtggggttcatcgccagtcccaacatcaacatccgcgctctcgctgttgaaaatttggtgccatactcgacagcagagccttccatcttcaaggcagacaagctacagcctgtaaagcacctcaagtttctgatcaaggatcatcctgtaagccttgacttaacccccttacaagcgcttctatgcgcccgcgcagacaaatgctgaccaggattatgattagaaaatcgctgaaaatgcagcgactatactggtcaacctcacaggcgaccctgaagttctggaggctgtagcaaccgacgagaaattcctcgaggttgtcttctcgtatataatcgtgagcaaaccctccaaaatggtagaaaccgttcttctggtctaacaaaacctccagaaccccgaagagcccaacgcaaatttattagctatgctcctggccaacctcgcaaaatgggatgggttcaagagcacactgcagaggaaacagaccgcccccgaggctctaggctccgacgacaacgcgctcaaccagctcatggacctctttgtcaagggccaggacggcggctacaacaagaaggccgactttgactacctcgcctacgtcttcgccgatctgtccaagcacgccgagatcaggcagtatttcctggcgcctcaaaagtacgacggcgtcgtgccgctgtccaagctcaaggtcttcaccgagcacaagtccgacatccgtcgcaagggtgttgccagcacaatcaagaacgtggctttcgaggtctcgtcccatccggccttcttctcagagagcgagatcaacatcctaccctatatcctcctacctatcatgggaagcgaagagtacgacgaggatgagatgctggatttcctgccggatttgcagctcctaccggaagataagaagcgggatagcgataatagcattgtccaaactcacgtggagacgctgatgcttttcacaactacgcgggagggaagagagctgttgcggcagatcaaggtgtaccccatcgttcgagaaacacattcacgggtcgaggacgcagatgtcaaggaggcgtgcgaccggttagtgcaagtgctcatgcgagacgaggaggaacccggaaaggagggagagctcactgcggatgagcgtgttaaggacgtcactgaagaggaggaaggagaggatgaattagtagaagtctgatattaaatgaaggcgaagacaaaagttattttttgctcattacaaaagcatgtgtagatgtagatataaacgagagtccgtataaagaagccattacccaaaataaaccaatagtaacagagttccaaatcgtgaaatccatgacagcatccatcgtgaaccgtaatagtaaccatgcatcatcaacaatttcagggatccagccaggtgtcgccctagctcgcttgctataaatgagggaatgaaacgaataaaagagcaaataacgcccctccaccaaccccgtgcaccggccataactacttgaaaaaaatctgactttcatcgcctgtctcccagatcctcctcgtgctcacggaacacgctcggtctggtctggcccagagagccggtgggtcgagccgaaatatagtcctgcccgaccacatcaccggctgttggcggagatatgggcgacagctgtgtttgctcagactctgtcctgtcgacggccggcctgtcatcgcccttctccactggaccgaatctggccagttcttcggggattgatctcatgccctgcctgtcgccaaactgctccggggaaacggggatggcaggcgactcgggcgactcggcacgcgagtgagcatcggcataccccgcgacggaagatcttggggatgagctgtacagctcggagggacctgacggcgaattggatcttgcggcagcggctgcagacaaggggttgtctccaagctcggcaggcggggatgtatctaaaaggcaaactgggtcagcaaactgaatttccatcgaagcagggagcattgtcctgtctctactcaccacctagttcagcaatggggtttcctcccatctcggagaattgggtaggctctggcgacgaagttggcacagtggcactggcagagactgatggcggcggagggggcagggggccattgttcctcagctctcccatctcggggctctttgtggtgctgtaaaccggaatgtcgtcggaggtcgtcactgtcacggccttctctgtgacatgctggcccttcatccacgagatgattctgttgccggcatcctcagttccgctctcggaagagccactcttcaggagcttgcgtctgcggtagaggcagaagacgacgatgacaccggtgaggaagatgagaccaaggacaacgccaagcacgggggcgacccacgagggaagaccagatcctcccttgctgttgccgctgtcgggggtaagggtcggtcgtgtcgtctgagtggcggcggctgcgtaagggtagtatgtcttgatcttcttcttatcgtaatcggtatcaaagaccttgcccaggtccttgttggcccagcctgatggagatggagatgtgagggtcgctccgcccgttggacttcctccaatggcttcaaccaccttgtctgggacgccatagtcaccatgcaccgaagggtcgtacgaggtcatccatgatgcgcttgtgaggttgaacatgacaactggccctccatctaagcagctgatggtgttgccagcctgggaggtgatgcctccaatgaccatcatctggtcaggatacggcttgaagcacttgtggccggttctggcatgcaaatcagtgccctcattcactttagtccaagtgaaggagggcagggacaagacccagacctggtcataatatggctgcttggggttgataccatcgtagcctccgtagtagtagatgttgtagctggaatagtccgaagcgggagcaaccacagcgcatcctcttgtggtggctccagggccattctgggtcgattgcttgtaccacttgtcgttcttaatatcgtagacatcgatctcctgcatgaacttggggctttcgcttttctaagagagggtttagaatctgtaatgagaagctgcgtagggaggttcgactcgaaaacacttacacttgcagtctcgttgtccgacttgcgcgaagttgttacaccggcccattcagggtaggtgacaccgccaagaacaacgaggatgccctgctcgccgacgggcacccagacgacctcggggtttgcgcgacccttgacactcgtcggcagtgtcttgtaggcccacttctcgctgctctgcgttgccatatccagcgtgaccatggaggtagagacgttctgcgccgtggtagaaccattcgagtatattacggtagtgagctctccctccgagggcgaagtcatgcccgggaagtaccaggccaggttctcggacggcgcgctgaccgcaccgccatatgtgatataccgacttacattgccgagtttagcgtcgacgaacccaggaccccagagcggcttgtccgggccgtactggtaggcctggaagccgagagcccagtgctcgtccgggttgtcgtacagcctcttgttctggaagaggttgccgccaaacatccaaaactcggcatcgttgtacagcatgccgccatctatgaagttgggcgcggcgccgagagcattgccggtaccgcccctcgccttggagatgtagttgtctgtgaggatctgcgtcacgtttgtatcggcagtaaaagacttgctgaggttgaaagtgagaattggtcccctcacgttgcctgcgtatcgagtcagtatattgaccactgggtttgaccaagaagagttgacagaccatcgtttagaacattcccaaactttccatcgttcatacccgggatccagttcaggtcgccgccatcaagatagatcatgtcgcggaccaaggcacctacggtcagtcagccatgtattcaggaaaggcgcacccatgtcatgtatggcatcgatggatatcggcatatatcatcgatgtatgcatggatgtgatcaaacatcccaggacgggtataaaagacaaacctcggagttgttcccatgtgcatatggtcgtgttgacctggccttctttccatccaccaaactgcgcaacggcagtgccggccaaggccgcgagcagtgattgaaccccgaccttcatgcttttccctccgcctttttttttaaatgtaaattatgctaacgaagccgaataattgatgaatcaactcaacaccgacttagaagaacatcacccggaagattggcggtggggaatgtgtggtgaacaattcctgtcccaatcttcgccgttggatctgcaaactgggagccgtgtctcgccgcctcacaggttcggttcccctctcctgtcttggtcgatagcagggtgatactgtgtgtctgggtctaaaccgccaggttcgatccagagaagatcagccgcaaacgccacggagttcgatccggctggacacatgcaatttcccgtgtatcagaacgagaggtgcgagtgagcaggcagtctttggtctcagccagcagtggtgatgagctgagggagaggctgggggtatggcctgggcccgctttgggaatcaagagcaccagagaggagtgagcacgtctaatggggtacaagtatgtagtatgtgagttaatgcaaaaggtcgattcagctgcgagaatccagcgattgggctaaccctgctggggcaaaatcacaatcacctgcatgaggtgaggagggctgagatacagacggcaaaccacgcagcgacaacacggatagatggatacatagcctacgacgagattatcttttgccacagaggaactagtaaagatgccctaatggcaacagctccgcgggctgcccggttgagtcgagaccgcgttggacagaagttcatattacggccccattacaggcaatggcaccgagtctggcggagcagcgtggacaagatcccctcattggtacattggatttccacgagccactcaaccactccatcacatttcacatgtgtgtccggagtacagtgtacaccctgggaccgaccctgggactgaaggtctttcggataagccctacccatagttgctgaccttggcgcgcagggaagtgggtggctacgcatgcagaggcaggggtggtgcagcaaccacggaggatcaaggaaaaaggaaagaagacctctgaaccgaggggaacaagcccgatagccttgttcgagcgaattgcacggctgacgccaaaaaagatcacagatgaggtagtgtgatcatggccgtcccactttggcatcgcaatcagagcggccgggcctactgatgatccaagctttggctacgtattatgcaaggggaggggaagaagtggtcagcgatcgcattgaggaggatgagtcttgcgggcttcgaaggctgtgtgcactacggatgttcctctcagcgagtggctgctttgcgagcgaggtgtgtctcgcccagagcaagtcctcatgcgtatatcgtattagcagggagctgagttgagaagagcaacatggcgcgcaggcccgacaaggcgaagatccccggttgttgttgtggttgtctgagtttccattggcgtcgaatatatgcgacaaaagcagccgcctatgcggccaacccgccattatggttcgcccgaatgtgagggtaagggcaattcatcagctcgtgtttaccgtgaacaacgacggagggttgcaatgatccagggtctatttggcgaccaagcgaaaagccaccactcagatcgaggcgcaggccacaagagtgggcggcctgaacggcggatggtaagctcccaagcagggatcggcggtcatgggccaccagttgcagggagggccagagtaaggttggagaagcattgacggtgaggtggcatgcccaacgcttgcctgcctaatcagtggtcgcgcatgcatcgtagcgggagttggctacctcgatgacgggcttcgcgaccgaagcacacagctgccctgccagtcccccattctttgcctgcgagctgagcgggtgtgcgtgtgcgtgggatggcgccccggtggtgggcaagttgcgagcgggtggtggcggatactgcgagatggggaaaagcaaaaaaaagagattgcaccccaaagtgattggcatgtctttccttgtttggtagcatctggttttttagtcaattgatcggtcggtcctttcggccttcgaggacagcaaggatgaggtgagatgggcagggtgcgagcagcctggtgctggcctggcccagacacgtgggaaccgaatcggatgtggagcgagggttcgccagccagagcagccgtagatcatcgtctcagaactccatgggtgcataggaaagcaagtactgggtgaattataggcgaaacgaatgccacggcatcaagtcaactttaagtaatacagctggagcgatgatggaccaactaacaatgccaggtactagagctagtattctccgtcgaggatagcagagacgcagcgcgtgctggattggtcgtagcctccgaggttgttggttgttgctaggccaagagaagattgatgacatacaatggcgccaagcctgctagcacttagcgagtggcaggggctgccagtgcttagcatgacctaagccaccggccttcccttgcaccacgcaccaccgctacaggccacaggctacagggctgacttggcaaatgtctcgcttgatggaatggaccttggaggggttgatgtgtgatagcgacggcatcctccccagcccgcatgcattgagccaggctttgtgggtggcggccgcaggttgatgctacgtaacgtgatgcgggtgatggctatccaaggctcaaagagtccaaatattggtgatttggagaatggtggtccatacccgaccagcctggccgctgagctggagcttggttgcccagggatcgtcgagttttagtcgtatcactgtgattgtggctgccgatgggttggttagcttgttggcagcaaattgtgtacatttgaccgccgtcagcacatggctacctcaacaatggccataatttgctgtcagctcaaggatatcacccaatgatgtttggtccgttgtcagtcccaagggtacctgcctgcactctccactggccaacggtggtggtgctggcggatgctggatgttggcatccgtagcaggtaccaactctttcgccatgcttgctaaaaaggctcccgggcggggaaatggagcgggggttggaagagcggtggggtggtccaaggcggccaatcagggtctcaatgcccgacaattcccatagaggcttggccaggtgacagctttcaagggaaagcacgagcgggtcttcctgctgtctgtgcctggcgctggtctggcggcagaaggcagctgcggccgacgggagaagacaaacgttcgacctccattccatccccacatgatgaattggaatttttcttcgtctgactgccaacaaaagaacgtgtcccctgtcagagtgtacgtcagcatcgcccccaatcgacatctcaatgcgactgttgggttgccatggaaatacctggctggctccatcgggaagattttccactgggtcggcctgaactaggcaggggcccaggggttttctcactcaccccacctatcttgggagggaacattcgattcggctggtttctggccaacctcgcatctgtcggtgcttctttcccaaggtggcagccgctctacgaatgcgattttcccgcggccggtgtgtctctctgcctcgctggtcttacacggctaacgtgtgcccacatggtcaatgacccgcgcgcgccaccttcgcgggctgaggacgcgggctgttttcgcaagatggtactggttcagagccttcagcccctcgtaaaaggctcattgtcgtcctccctcttgtcttagagccccacttgcgagatggtggcttgcaggtctctctgccggctaacgttcttttgttctggccaagcactaacacgcatctcaagggaccgaaccgcactgcgcagtatcacacctaaatctctctcatccttggcgatggtaccctctggcccccaacaccgggtgcctgttccacccatcgtcgagctatgccaccactcgaatgatgagtgcggaggttaggcactgagatgtcgacttctccgccgccagtcatccctctccatcccacaattcggcctttctctcagtacggtctagaacgagaattgcaacccgacccctcgaggattgaggcgatattcttgaaccttgcttgggtaggtgcgggtggagatatcttattctcccccaggccaagccaagctgtatctcttgttctcgtgaatgtgcggtgacccatgccccatgctcgctgtcccacaaagcggctcagcaacctacccaaagtggatagctacatcgacaaggatacctccgagtattctcgcgcatcttcttagccttgattctgcacgcccgtgcgcgatggtttagccttgcccgcggagaggcgtgtccctcgcatgagagtgccggccctgtctcttgtcatgatgtgccgatattagtccaggagctccccatctctccgtgtaggctgcgtcgccacccgtcctgcttctcacctcccctctccgtacgctcgctctactgaactctgtgacggccaattcactggggattcctgctgtctcctcttggcctgatcagtgacggtacaacacggcaacaagcgcaaaggcattggtctgcctctgtccgcctgtccattcgtttgccctgttgaggaccgctccgcccctgcgttggtagctggttattcatagaaccggtagcctgggtaatctggcagagcaaggtttcgtgcctaagccttgccttggctcatttggaagctgcaattacatggtcctagctgttgtgtgtaatattgatgtcaaggtacaaccctagtcaagtgttccctctccccttgcccacctatgctggctgttatgaatggacactccctctgactcctcacgagtaatatatagggctgattccgacagctacctctctctaacgcctcacgcttgtcctgtctcccaccctctcgttcaccgtgctttgcagacatgcgcttctcctggggactcgccgttggcgctctaagcgccctgcttcaatccgttcgagctacggacctacctcaaactcccgatcctgctattacacaggccccagtgccttcgagcaactggaccgcccatgtcaatgttattagcaacgccgtcaacccggacgcggcgaggtgtggaggatgttgcacagtctacgtcaattcgaccttcagagagactgtacgtacgccccagttacactgggatgggaggatggtgacgctaacgccatttgccagacaattatctatgagacaaagacagttccaacaactatcacagagacgtgtacggtcacggtacccacgacggtcacagtcaaggtcccaacgacagttatagtcaaggtcccaactactgttggtgtcactgtgggtgtgccaacgactgtcaacaagcctacgacaatcaaggccactaccacttacaccacaacgtacacgacggtatgctttcgaaaacatcattccgatcctgaatacacgctgaccgttctcttcacagtcctatcctgtcacaacaactaagactgtcaagtaagtatttgaagatgcgctcgcgcggattgaaatcctgctaacactactctagctgtcgccctggttcgaccacatcatctccatcctacccaacgaatgtgtatggcaggacaccaccgcagccgatctgtgataccatcaccaccacagtgtggacgaccacgacaaccaccgagctgctttacaccaccgtgcccaccacagtcgttgttccaaccactattgacaacaccgtccaggttccaacgacggtcgacaacactgtgcttgtcccaactactgttgacaacaccgtccaagttccaaccactgttgacaacactgtccaggttcccactacgatcgacaggacttcgtatattacgaagacaaccgccaccccaaccacggtctggcaaacgaccactttcacggagacggtcgagcgcacagcaacggtcaccagtggaaccaccatattcaccactgaatatagaactgtcacgagtagctacccagtcgtctcgtgggcgacatcgtacatcacagagacgttcaggacaactcttcctggtcaggtcactacgcttcctggatcaacgagcatcactacattcacagtaacggcggatggcacaacgagcgttgtcacatcgacggttactcttcctgcgtctaccgtcactcttccaggttcggtcacaacacttccaggtcaggttacaacgcttcccggaacgacaagtgtcacaacgctcacagtgacggccgatggaacgacgagccttattacatcgacgattactctgcctgcctccacagtcacgcttcctgcttcgacaatcactcttcctggccaggtaacaacgcttccaggccagactgtcactgcgcccggtgccaccatcactgctcccgcccagacaatcactcttcctggtgaggtgacaacactgccaggttccacggtggtaaccacagccacaattctgggacctgagaggacgatcaccgtgacaagagacggctcgacaatcattagcactgtgcctggcccaacatcctacgtgccgacaaccatcacgatccctcctgttacagtaacagttccacctaacacgttgaccgttacaaccatcacttctgtcaccctctgtccagccccaactgccactctcgcatcaacatacaaacccaagtccaaattgacatttgggtgcagcccaggatatgtttgcaaccctaaaaagccggacacctgtaatttctggcctgcacctccggcaaacgagtacacgtgctcctatgaggactgcattcggtccccccctatcaagaatgtgacttgggagggcaaccagactggttactaccccccgcaatttggctacttcaacttgaaccccaacgccttcggactggcgtatgatattttcgaggctgaagttattgtgaaggagaagcatggcaagctcgtgactattaccactggtaactgggcgtctcaaacatctatttccacctttgagcggtcaacctcgactgccgtccctgccgtccgccgaagactggccaagcgtgatattaacactgctccggcgatttgctatagcacttgcaacaacgcatatgtcctggcgtcgtctcttggcaagagtgatgaattgtgcgatgcaactggcgacttcattgctggctacaatgcttgtatcaagtgtatcacggataacattggagaatctcagactacccccagagatatcgtggatcctgaatttggacaattcttgaactactgttcgggatccaacccaattacatcgacatcgtctactgctagcggaccggaatccgccgtgacctccgaaccctcaattaccacaggctcacaagtcccaacaagcagcggaggcttttctgccatcaccagcacggaaaccacttcttcaagcgccgtatcgtcctcagtgagtagcgcttcttcaacagcgtccacttcggagccaacatctacaattgctacatccacatcctcagcaagtcagaccagcgagactctctccaccgtgtcaagctcctcgtcttcaagcgcctctacaacgagcagtgctaccacgagcgatgtcagcagctcgagttccgctgtttcctcggcatcaagctcgagcagttccagtagctcgagcagctcaagctcggctgtctcttcaagctccagctcctctgtgattgtatccagcagttcaagcggcttcagctctgctgtggctacaccaagcagcgccagcagcgccagctcatctggtatttcaactacaggcagagtcgacccaaccttcgccagcagtagcagtactccatcgtcctctgcgcagaccagtggagctactggaacactcccaactgtccccagcccctcggttagtacactgcctccctcggcgggtactcgctcaactgccggctacaccctcctggtgaccgtcctttgcatggtcgccaccctcttcgcgtaatacccttccagtgaagagtttctgtaatgtttttttttcatgtgcgcctcgacgcacattcacgactctcattaacaaacgatgaatgaatattcacgctattttgacgatttctgggatttctcgggaaagaacggtgtttttgtgagcccagccggccaaggcatggccaggcttttagttgggtgttgttttttcctgatttgattgtttggttgccaaattttgcatggaatggctttaattaatggatgataccccacgacactcattatagacaacgggaggcatgatggatgattccccacgacactcactatagacaggggatatgtgattgataataccccaccacactcatttagacaatggatcacactgatgataccaagacactctcttatactacaaacagatatgctggggaaatcgggtcagcatgggaggacggtaattgggctcgagccatcatcgattggcttgaaaagtgtgctactgcgagagggagaacttggaaatttgttcaaagtttggacctggcgccgattggcctcagaagaaatggataaaaaatgaaatcattttaccattcaaccgatgttcaagtacaatgtgatgtgacctgcaagtaatttcatctcagttcatcgtacctaggatcaggcacagtttcgtatattgaaaatcgcatcttcaatcatcagtataggaatcagagcagatagccggtgaggtagatgttatagtagagaaagacgtgcacacattgctgtcattcatattctattccaacaacattatcaacaagtgccttatttaccaagaacggcttgtaccgtgacccctattgacaaacgcccaaaaacaacaaaagacttccccctaagctaataaacaaaacgccatccctgatgtagacagacatccatttgatctaacaagattgcccttaccatgttactcatttcaatcattcaacaacaaggtcctcgagcacattcatggctttcgacccctcgctttcaaaagaactgaccatcgcctcacattcttgcttcaacagcttttcagcctcgcccgcattgaagtagatccattcttccacggtcatcttcttctcggggcttgttaggtctttacccttcctcagaagccgcgccacgccattctccttatcgccagcttggtgaggagtacccatcacggtgtcaatgtctacagccttccacggtgtcttgctttgaaggccggcaaccacattgcgccttgacggcgagccacgcacgggcgttgcctctacaggagccaacacaactctctttgtcctggcgcttgctggtggcttggatgacggtggttggttttccgcgtcagatgactgcggagactgggatggtgacagagctgcttgccgagccgatggcgctggcgagactcctgtggctggggtggatggttgtaaaacgacgtgattagactccgaacgcctaggcgttggtactttttgtcgctccatgaagggggaggaggaagggtctcctacaatagactcgggcccctcgaccaggtcaaccgattcatctgcgcctgcctccgcttcggccagtattctcgcctcggctgcatctgattctgctaacaactgggcgtcaggctcggaaagagcaggctcttctttcgactgcttgggtggccggccgcgcccacgcttaggcggagcggctgcagtggccggctccgggcccttgacatcttccatgaaagaggctgaaagtgaagccttggaaggtctgccgcgtccgcgtttcttttctggctctggcttagcttctgcctttggctccaactccgtctctaggttctgcgttgaaacttcctgaggcggagccaggtcttgcgtgggtgtcttggaaggtcgcccgcgagaccttttctttggtggctcaacctcctctacggccagctcatctacatcaatggagacttgtgaggccagcgaatgcttagatgggcgcccacgtcccctcttccctaggctggttctttgtggctccgacttctgaatgacagtgccggtgctaccaacactaatctccggctcatccacaacagggtctgaaacatcaggagctgccagctcgggttcgggctcgttctgcggttcgaattctggctcaggctcaggctcaggctcaggggcaggctgagctttcttgggcttggcctgttttgacgccttgcgcgtgcctgcctttcgtcccttcttagggacctgtagttgaggtagctctggctctgcttctggctccgagtccggtagaggctctggttccgcctcgggttgtggtgtttcctctggttgggcaacctccatctctgcacgcagagcctccaattcgtcttcgatttcatcctcatccggttcaactggatggggatccagcattgcaaacgagtctgatttttgtatttcgaccgtcttatgaaaacttctctgctcctcctcgacggatgccttagctcttgacctagaacgttcagaatcagaatctgctgcgatctcctcatcttccgtaaggggggcttcaagttcagcttccaattggcgttcaatctcgtcatcatctggaaagcctcctggcggtgccctgaagatttctggggaagacacaggtgccactaccggagccttttgggatttctgtgcgctcacgactcgacccttcttgcgcgccggtgcggctttggtctccacgggcacatcagcagggctttcatcgtccgaaaattgaattgccgaactttcgacgacggtattgccacgctttcgagtagctcgcttcttcgtggctggggcttcggactcaacaactgacggctcctctatcgccgtactgggccgcttctttccacgcttggtcttgctcggctgggcaacaggggattcttcgatgggtggttgttggtcttcaagttcgtcttgcacgacaggctcttgcacgacaagctcttcctttttgctcttagccttcttgcccttagctgcgggggccttttttgcgcggcttttcttggtgccaccttgcgtcattacggatgtagttgtgacgacgctgtcgtcaggtgctgcgattgtttccgctactgatgctgattcggaggcgatggagacagccgattgtgtagacagacgtgaagccttagaacctcgtccggcctttgtacgggttgtcttcttggtttgtttgtgttcttcaacgagtgcgaagaaggcgcaattcggtgatcgtttgtaatgttcgtctctttccgattgtgagtatacatggatgaggagaggaacgacaagccctcataaattatcatggaagcaaaaatttagcacttactttggtttatcatctgcttcccaaccatccatggccaactggcagtatgtgcaggttgtcatatcgtccgaatctggtgtgggtgtgtacttccatcccgattcaacgagctaagaaaggtcaattcgtcgttcctgccagtttgccaatacgattggatgcgtcctgatctcacctgcttagttttgcatttccaccctctcttgttctcgtgaggccatctgcctgcaaatgttgcctttcgcgccattgccatgtcagggtggttaggatcctctcgccagtacccttccatctcagcctcgatggccgcgacaattgcccatccgcaaccgggtgagtgtttcagatgctcgcgcaaagggtcatcgccctcttcccagccatccatgctcttctcgcagaggaagcaaacaacattgtcgggattattagagaacggcaagaagaagaaaccggctcgtgcaagctagtttggcgcgcgtattagcaacctgctgacacggttgaagctcaaggaaaggtgggagtgctcacgctctctggggagatggtcttatgtggccaattctgagccttcgcgcctcggccgcccgctgttgagcctcgcttcttggtcttctggaacgaagcgagacggccgtcgaaggtcagatactggtcatctactgtgatatccgccatgctgggcagactggtggtgttgtcgtgatttgcgcgtcgtgatcgttcagcaaaatatccgcgtcaaaacaattaggctgcaggggcaggtatgcgattggcgccgatatggggtctcgttccggggttcaggtcgagcgtgaaattcgtatcatatctaatcgttggagcgtgacctgatcattaaaagatagaggtagaagtataaaggtaggtgaagtgaactgtcaagagaaataggaattatggatagacacgaagacggacgcgagagccaaacaagctcgagggctggatgcttggagttccagtaggtccttgcaagccaatgactgggggctgaggcgaatgacgacgagtgaagtgggcgcggaccaaacgcgtttgtttactttgaaagatgttggtgggagtttagtggggcagttgctggcgttttcattcccgtttgactacaggtccacatccccaattatatcgacttaacctgtacctcgggcagccttccatctccaagcaccagcacagtcagtaccaacaccattagtttctcgacacgtagctcccacatgatgtagctctacagaggcactgtagggggttgaatcatcgggaaacacaatgtttatttcgccaatgaaggtctaagcatcgtaacaagcttggccgccgcgactcacagcttgcccagatccttcaatgccttctctccatcaactagaacacaccagccttcacttcccctacctccatccccgtagacaacggcttcaaaagctccatctgtcagggcaaagtcgagtacctccttgttaaacgtaccgggctgcagccacacagagggaataccagccgttttggctgccttgagcacatcaagggtaacaggcggaggtgtaatgatagagacaccggtgttcctagggtctgccagctcctggacgttcttgactgttgggtaatcctggccgccgacggtaacagacccagaacctgggttgacgggcgtgacaggaagcttgtgggccaggtaccatgcgtgcacttgataaagaataacgatcagcaatgcagagcaaagaagagatagcagggggatcaacccttgtggccaaacttggctgggtttgagctggcgccgacaacggcgaaccgggccgcggagaagaatcggtgtgcggttgcttcggtcgacattgtttaaagtgtagtggagttctggatgggatatgggggattgtgattaatgcttcaccaagatgatggatagtatgtatcggagtgaagaatggcgacaggactatataattgagcttgttgctaatgatgccgactggctgagaaatgacgactgcggggttccacggatggcgagcgcggccgtttgttcttcattactgcaacgggcaactggatgatagccatgtagcaatgtgtccaaaatgtttcgcccagccaaggcatctcgaggcaaaaaacagattaggacttgattccggccttcacatgttcctcttctgcttaatgctacgatgctgtcaacaggctctccacaggctcggagtttacgccatttagagaggaaagtgtgtcgtcaataccctacgcttttcagcatcgacaaacgtagaaaatataacctcttatattcgattcatctgcctccagttcagataaactgggatgtgaactgaacatagatctggttaggctaaatgaagattgaggggaattgttccttctactgctactgtatcatgtttttatagacagcatcctcccacattgtaagtagcattgttgattaaatgagcaccccctagggtaatttggaggtgcttagcttgtgggaggtgcgggatctgttatcgtcatggctgttacgagtaacgaagatccgaagtgtcatcttttcgctgccacatttttggtagatgtatgattattagctgtagtttatatagtagataatcaacatctggttattttattcatagtcctcgtgcctccgtgtgattttatgaaagcttagcacaccgccgttgattgcatagccgattgcaattactgctaggcagtggcttgagcattgccggccacgctatcgaggcccgggacccaaaacaactgtctcaaaaagagccatggcttcaatagcccggccggctggtcgcagggactggggcactgtcagcttggcggcctgtcgttgactcgttgccccgtcagtggcagcatggacaggcaggaaaaaaggggccatttatccacggtgcgcataagcgggtgacagagtgcaccgagttatgaaaagaccagatcagacaacagaaaaggccctgggcaccgccaaaattgatttctcgtcctttcatcatcaccattaccagttttgcacgatcctacaaccgctcattccgtcgcctttttgtgtgacaaaccctcctgcagccaggcaagacacacaagacaccgaatctcgcagccgctggcgtatttgtttaggcccccctaagtaccagtaccaccgacgtaataaacacaatggtgagttgccccggcacccgaaggcgtaaacacagccagcagcacaccaccccgccagcgctcgtgattcgctggcagatgcactggaggtctgccgcatttccaagcgcaaaaaatagaagaccgccaaacagtcgcatacctgcccaattcctctcctttccatcagctccgatctctgtgcatcgctagaaccaccaagcattactttgcccaccatgtcttctaaccacattgatgcccaggcctcgaccaactacaaggaggcttttgccctgttcgacaagcgcggaaacggccgagtcactctcgagagccttggcgatctgctccgcgcctgcggccagaaccctaccctcagcgagatccaggacctcgagaagaatgttggcggcgagtgtgagtgccctatttcatccatctgcatgcgaccgatgacggtcccgatgcgattccgatgctgaccgtcccagtcgacttcgagaccttccagcgtgtcctgaaccgccctggtggcttccgcgaccccggcgagcctgacgagtactgccgcggtttccaggtcttcgacaaggatatgacgggctttattggcgtcggccagctcaagtacatcctgaccaacctcggcgagaagatgaccgacgaggaggtcgacgagctcctcaaggccgtggacaccagctctggccaggtcaactacaccggtacggacccctttcccccgatatttcgccaactgtgcccttactgactggtgttttgtttttctagatcttgtgcgaaccatcctcgccaattaggcgatcacgacgccaaacaagcttgcttttatgttgcatctgcgtttaggaacggcggcgttgctctatttacatgtgatttggcctgggattgactacattgggattggaatggatggcgatgaggtaccgcgactgtaagatgagatgtcgtatatggctattacggtagatagcttctcgagtctcgaggcatcactctaaaacgtgctgcacgggactgcgatgttgctcttgataaataaacattataagattttgtatcgctaatcttaagttgcgtcccaacacatcgcatggaaccaagtagtgattgctgtccacaaaaacagtccaaactgcaaccatgacttgaggggagatggccctcgtgtctcgttgactccttgggcgcatatcaagaggtgtctagttcagggatggtttgatctgtccctaatgcccaattattctgacatagaatgtcctctaacaaaggtgtttctttgactactcatcaccacccatacaaccagggctcatttagggtagtcattggatctgccatctaaccaacatcaaaaccgagacccacggtccggcactgatcctttaacatgtcttcttccaacccatagatacttatgcattctctatggctttgtgattgagagggctgccgatttccagcggcccaacgggctggaaattgcttgctatgacagcccaatttcggcctcggcgatcatttgaaggccgcttctacgaaagttcgaaagtcttgccttctgtttctgtgcaatggttgcgccttgccagttttgggggcttaccatccaacttctgcattagaatatacccaatgccgacggtgtttgtcggttcggactcatacgcccaatcacacattcgtagcgagggaacatttgtatgacggcccaggaactccatggtcgcggcctcgctccgcagcacatacgtacatatgcacctcggtcggcggtgatattgcactggacaagcgggaccatgcgagccaaacctcgccatcggcgaaagccagctcggcatggcagttctgagcaccaatcatagtcgggaaggtcttcggcgagaggtcaatcgtgcatgtgccactatgcacctgtgctgcacgtttatatactgttgtctcccgctgtcgatttgtcggcatagtccacctagccgcagggaatcttctgctgtgtagtgcgcactaaaggtgctccactgcagctggtgatgcctatgaaacccgattctttgtagttgtgtagaagagctaacgccaatgaaagcattaaccttcgctttggggcattaatgaacccggcaaagatgcctggtgccgagaacgtgcttttggcgcactggtttcagctcgataccctagatcaagtctaaaagccaaacacagtaattgatgagaactcaagcatcccaacgacaggggagaccacatctagataaatgttgattttgacattgtgagcataatgaactaggaatagggtagcatagtctcaaacaagaacaaatgaaggaccaagattgagaggagtaatatatatcaaagtctctagtgtgtgccacaaggaagcatgccaagatgttgtaggttgcattacgaagaagattgacaaaagagctttaaaatttaagggtcaacatagggttagcacttatagagaaagaaagcatggaactaagtcaataaacaaggctcgtacgtcgtctatctagattctcaggaagataagtgttaaagtaacctcctactaacctatttcctatggagcagctagcagagtcttcccgtcacactcaccccgcttctggcgacagcgcatcatcaggtgctccgaggcacgtaatggaggggcactttgaaggcgagtatctggacctgaatcatgcataataacattggatggttatgcatttcgatactgaggctgcgccgcctcttgcctgaatgcgtacaccgcttgttctaccgccttccagcatcgacacattcgggtcgagaaaggaaaaaggtgtgtcatgaggtaatacagcatccctagactgatctgctcccgcgcgtagccccaagtacctgtgccgcaaggggcatgagggacttgagatgtgacaccatcggacttgcagtgcctcgagatggcggggcaatgtagtgataggtcgataggcgcctgaggaatcatctcggcccaccgctcctgccgcctgctgtcgcatccaaggttagtaccttccggtccttcccccaccttcagccagcccagtgtaagagacagaacagcattttcgccccgttcaaataaccccagagcccaattgtctgctcctgcccttgcctccctcttgccattgatccccaggtgtatctcgcctgtctagtacataagctggatcgacgcgtgaggcccacttccctctacttcctccttcccctcctcgtcctccttctagccgccaccctggcttcccaacgagcatttcctcgcctcaactcgctcgtccaccatctaagaacccaggtggtccctttccgtactgtgactacgagcgccatggtcgctccccagttccagacgcctcctcaggcacctcctctctttactcacactgccgaagccatcgtcagtgagacggagcggttgaacgccaactacaagaagatccttgatgacattgtggccagcacgaagccggagaactccacatttgccaaggctctggagcctgtcctcttcgaggacaatgagactgctgtgtcccgaaggattctcagcttctaccagcatgtgtcgactaaccaggatcttcgggcggcctccaccaaagccgatgagattacgacccagtttgatgttgaatgccgcatgcgagaggatgtcttcaatgtggtgaatggtgcctttgagaagagagagactgaaaagctcgagacggaggctctgcgcatcctggagaaggagcgcaagaagtatatccgcaatggtctgctcctccctgccggaccgcagcgagaccgcttcaaggaaatcaagaagcgcctgggattgctgtgcattcaggcccagaagaacctgaacgaggagaaggctgctatttggtttaccccggaagagctcaagggtgtccccgaggacgatatcaacattgctgacctcgagaagggtactggcgagaatgaaggtaaagtcaagctgactttcaagtatactcacttcttccccttcatgaagtatgcccaagacggcgaagcaagacaccgatacaccatcgccgacgccaataaggtaagttctattcgtgctaaattcgaaagccttccaatgacgtttttgaaatgctaattgccctaaaaggtcagccaaaacgtacctattttccaggagattttcgagcttcgtgacgaggctgcccggctcctgggatatcccgaccatgcaagcgttgtgattgaggaaaagatggccaagaccccggccaaggtcaaggaattcttgaatgatctccgtgttcgcttggccccaggtggcaagaaggaagtcgctaagcttctggaatacaagaagaaggactatgaagcgcggggcttagactttgatggtaacttttacatgtgggacacctcctactactctcgtctccaaaaagagcaggagtacagcgtcgacgaggtcaagatttcccagtttttccccgttgactcgaccttcaaggggatgctgaagatcttcgaagaaattctcggtctcttcttcgttgagattactaaggaggatgcggcacgcctcagcaagactggcaaggctgaggatatcatctggcatgaagatgtaaagctgtatgcagtctggaacgacgaagcaagcggtggtgagtttgtgggttacctctatatcgaccttcaccctcgtgacaacaagtacggccacaacgccaactttggcatcgaaccgggctataccaagaaagatggaacccgaagctacccctccaccgctttggtttgcaacttcagcaagcccagccctaccaagccttcattgctgaagcacaatgaggttgtgacactcttccatgaacttggccatgggatccacgacttggttgctcgtacacgatacagttacttccacggaacatcggttgtagatgacttcgtcgaggcgccctctcagatgcttgagaactggtgctggacaccaagtgtcctcaagtcgttgtcccgtcactggcagacgaacgaacagatctcggacgagctggttgataagctaattgccagcaagaacctcaactccgccattttcaacctcgcgcagctgttgatcggccttttcgatatgactgtccattcgccagaatcccaccaggccgccaaggatctggatgccggaaagctctggaatactctccgcggtgaaatctctggcatcaagggacctgaggatgtgggagagggaatgtaagtcaatatccaacaccggaccatttagcgtcttgtgatttcgctaacactacgtagtaaatggggcagccggtatgcccatatcggccactttgttggtgggtatgatgctggctactatggatatctctggtctgaggtgttctcgacggacatgttcgccacctttttcgaaaagaacccgatggacccagcccagggtcgccgataccggaaaattgtgctggagaagggcggcagggaggatgagatgggcttcctcaccgagttccttggcagggcgcccagcactgaggcattctacaaggagctgggtctggcctagttctacagcaacatggcacagctttacaggagaatatataacgtcaaacaagtatcttgttaaagttcacaattagtacttaacccctcgattttcagagaaatccggtgtcatatggtgaacgaagggaacaagagaagcattttgaggcactcttgaactgtgcagtacgagagaatatggccgacactatcttgaggatacaacctgttgttattcccaactaattatgaacaataccttccaataagaaatatactcttaagctatctagggccatcaattgcaatttagaacggagcctgggtagaaggatttaaacgcgcaagtgtaaccaaatgacgtaattcgaatcacgacagatctagccatgaaagtattatgctgagaagcatgatgggagtcggtggtaatatcaagtgagaacaagaatatacctattggtaagcagcgtgctgcttcgtgttctggtacgcggttggaacggtgatcttgtttatgccagagtcacgaggtctggttggggccgtgggttaaggaaaggggaaggaagggtggggcaggtttccgagaatgaggatgcgctttcagccagcatccttttgtaaatccgtgcatatctggcggagtgcgtgcgacatgggcgcattcgtgggtggagtgacggagcgccatgatcagcccgtgggatggagggtcgagttcggagctgagcacatggtgtccgatgtgtatccggggtggaacaggggagtgaaaggtgtggcttcgggaggaaaaaaacaaggaatcgtgtaatagtctatctcaattgggggagactggcatgctgtggtgattgtgttctgtttgagtgattgggtcttctgaacaaataccgcagcaaggaatggggcgtaagaggcaagatgggagaattagaatgaattctggggaaattgatggaagtactggaatcgatgtataggcaaattagtgaaataagcatggcatccaacaccgtgcctttagcccctgaaatgtgaattatgaactccttttcgtcagttgagagctctgcgactgagggtagagaacccataagcattttgtacggtgattatctagaaatcgtattttattttactgtgttcttgtgttttctcgggataccatatctacatacctctgtggtaggtatgattaatctcgcccacctggcagggtatattcagcatcttcgagcctacacagcgattgcgattatctatccatgttacaacgccccggggaataaatatgatgcgggatgcaatagatcagatgagctcggcggccgactttgactgtaatatcatcacaccgcccgctgggttggttgaacacgagtgactcgggacgagactcgagggcagcacggaggcgggttattaaaatggacttcttggtgcaatcattggtctgcgacgagccagttaaagatcttctgtcttccagatcttttgttcggagggttcatgacctgtgaacctcgttcaggatccttccgaggccgcaaccgatatcttctggtggaacaccacgccacgctgctcggtgccgaggggctctaccggcgatgcatttgattggtggctctgttgtacggcacagatcatgctcctacattcgccgttgtatttgttggatattcggagttggctaggtgccatgctgattgcttcggcgacctctttgcaaagttaagtttcctatggctctagttttctctcacgcaactgaatgtccgtcattcaatggtacattctcagccaacttactgagcttaatataaatccgacctagggaaggggaaccctgaccaaatcatgttgtacagggtcacctgcatatcggtcaccagcatgtctcggagtaggttcttcttgcgattggtagctgaaatgaggcgttaggccatttcgatccatccaaaacacgtcaagggtagtagtagcagctaagaaagatgctatattgagcgatcgaagttgaactagcaaactgccaacagccttgcatgtgcggcgtcagacaaccttgaagttttacgggccattgccattgcgatgggagcaaaacggttggctgattgtagtcgaccgacacatttcgcaaggcagatagagctcaaaatgcacctcgatgatacgagctacgttggtacacatctcctaccagacaacgtacccatgcccggcccggaggaggtggaaaaggcaacctaggcagctcgttctcgtgggacgtgccaagtctgacatacacttcagctgaccgacagaaagggaaaatgagtttcgttgtacttggcccttgctctcatgcacacgtgtttcgagctacacgacatgcaggtcgggccaggagggacagcctcccatggatatgattaggtatgagtggcctgttttgcgttgaggagggccaacgtcagcgcctcaccacgcggcactgtaacatcagatgcagtgtccgtcacagtgatgtgtatttcccttcctcacgacacatcctgtgtgcctttttgaggtagtgcgctgcagggagacggatacaggagacggagtggtttggcgcttcagatcggcaacaggatgatatgcgtgtgctagggccgggcttggcgagaaatagtcatctgcgacattcaggtaactcagcaaggctatctggctgttgaggtttaaattaatcggcgcagtgacgtttgtagtctcgaggtagcctgacttgcctcgctcggctgagagtttattcggcatgcaggtatgcataggttaaatatgatatcatgcaaaccggtacctaagatgagagatctacgctttgtaaatcctaaacgtgatatccgtttgctgttctcgcttcagaagcccggttgtcggtggccgggtgtgaccgtggactgccacttccctacataacttcttcgcttatccatgtggccttctattaattgccagccgtatcccctattcactgtacttttgttctatcaaataaaaataaccagaaaaaatagtcgtctcttgtttgcctgtttcgtgggtccggtggtctctacatgcacttttgccactagcaaaacatctgacagcaactcaacgttgtcactgtaagaggaagactcccattcatttatcgtgttggcccagctggagaaacgtcgaatccgtccctgcgcctttcatctaaaaagggcactgtcaatcaacagcacctcatcatgatgagcgacagcgagctgaagtcctcaaatgaggcgttctcgacctttgaccatgatgagcggactgatccgtactgtggaatgtccgcagaagagagagagttagaggtaacataccccccttgttcttgattccataatccgctttcgctccttggaatagggtcactgataagaaataggagcgtaggcttctgtggaagctggatattcaactcatcccatgggttagtacatgcgcactggggtgtctcgcaggcgacagaatacactctttcgtctgatgaaacctgtctcattacctgaagactcagactgactggtagttagctttgcctgttgtatttgatatgcttccttgatcgaactaatatcggaaacgccaagattgctcaccttactgaggacatcccgatgacgacgaacgagttcaatgctacattgaccatattctttgttggatatgccgcgtttgaggtccttgccaacttcttactcaaaagattccgaccgtctatatttataccgtctacaatgtgagcaagcggtctacagtctggctcagaccaatgctaacttgtacatttcttctgaacagggttctctggggcgcttgcatgctgtccatgggttttgtgacctcttggtcaggcttgatggcaactcgatggtggcttggagtcacggaagctggcctgttccctggtgtcaactactatctctcctgctggtacaaacgcagcgagttcggtgttcgggctgccatattcttctccgcagcggccattgcaggttcatttggcggcctcctggcagcggcaatccagacaatggacggcgtggccaattacgccggttggcgctggatcttcatcatcgagggggccatcaccgttgtaattggaattgtgtcgtactggatggtgcacgattttcccgacgaggccaagttcctgaacgaagatgaccgagcgcgggtgctactgcggttgaaggaagacaagcagagctctgcggaacacgaggacttcagaatggagttcctgtgggctgcactcaaggattggaagatgtacgtgggtatgctcatctatatggggcccctcatgccgctatactcgttcagccttttcctgcccacgatcatccagaacatgagcttcacgggacccgaggacatcatcaagaaccagctcctgagcgtgccaccgtacattctcgcggcgctcctgaccgtcgcggtcggattttggtcggataggatccagcgtcggggcatcttcaacatctgctgcgcgcccgtcagcatcctgggctttgtcatgctcatctgcacgacggacccgatggtgcaatacgcggggacgtttctaggcgcgatgggtatctaccctgctatatcgctcaccattgcctggatagccaacaatgtagagggggtgtacaagagaggcatcgtcctggggttcgtgattggatggggcaacttgaatggcgtggtgagcagcaacatctatttcaacgcaccgcgattcttcgagggccacgccgtcatcatcgcgtacctgtttatctgtatcttcggaggcagtatcctaatgacggtactactctctcgcgagaacaggagacgcagtaagggactgagagatgagtgggctgagggtaagtccgctcaagagatcgagactcttggcgacaaccgtcccgactttttctacacgctctgaagtgagagagacgatgatgccttacaacgttggaaaggagaattcgagtgtcagattgatgttttgtttggagattggatttttggaataacaaaggaggggactgtttgaaaagcgggacagaaggaaatctggtttagtcggggatgtattgcaaagggtatggatatattggcttgatggacagacgctttcatcttcttcgaagcacatatggtcatggcatgtgtgagcatacttacaagtattattcttttaacagggcacagattgggcagggctttttttcttgggggtagatatccaattgatcgatttatcacttgatctttgatgacaattacaggcttagaataacgaagaacgaggggaagaaacaagaaaacacataagaggaagggacaagtagaagaaatagtagaagaaagaataagatagaagaaagacagcagagaaaagatggactcttagggcgtctttctaagatgaatatgatagagtgattgggcgaggcttcaatgacttccgcagttttttctcgcttcttcaccattttgaggtttcgcggcagctgtcatggctttggcatctttctttctgccccgtcctttctttggagcaatagttggatttggccttcttccctttgccttcatggttgaagaagcgagttcaacaacggttctagaagaggcatgagccttctttgcttcaatctccgcgcttcaggcgctttgtgtgagcttcaaacccttgcatcggatttcttgggctggtctgaacgttggggccgtgggatgtccgacttccactgcatcaagtacatcgatttcagagggggtggaatccattggagagattgtccttgggggcagtggggtaggctctcgtcggcgacgattgattgccctggacgttgaacgtataaacacggtcattgtcctcttaatgtgtctcgactcggtctgggatctcctagtaggatccaggcagtattcttgaggttccaagcacttgttcttattatgggctcgacactgcggcggagtaagggaagatacaatctgccgggctcacaaaggaactgaggctaattagctcctcgaagagttgcatcatgagagcgcttgtaagatagtagctgcaacaatcgcaggtagtcggtatttatactcatattgtgccccttgccagcgggggcggttgccagccaatagcggcaccaacatgtgcctaaaaccgtaatcgccaacccttgcccctgttcgctgtggggagatggaggcaccgggtctggtgttgatgccttatagccgattaatagagagccccatctggatgttggtttgagagacacttgagtgtgaatcaagatgaatagattgccgtgtcagtcctttagctcattgacgccaaagggatttagaatagtctattgctatcaatgtagcatttgctaccacctggatatatatgcaggtaggtaatctgcgactctctcccaacggccttggagccctttgacggttgttggtattgaggatgcagagtatgcggtaagtatggctgggagtaccgcatcttgatcgatgcttacgaatcccatcttaagtggtgggctatgatattgctttagtgccaatgctcaagatcaccggaaccagacaccccgaagaggacgaccgggtgtctgcacgcggaaaagattaaatgatcaagtctcacaccaaatgctgcaagtatttggctccttggcttggaatagtgtctgctgctgtcatgctaagcttgggaatatcttgacgactgttgtacagagcgagacagggcaagttggacggacatggtgctattggtgttcatacgcgataaaggtgatgccttatatacaagttccccgggcatatcattcaacaagaacaacagcccctgtggcgcagtggtcagcgcgctcccgtgcggtttccctgtgatgtactcacactgaagagaagaccgagtgtaggtgtatccccctctcccctacggtaagtcaagagaacgagtacatcacagggccacgagagaggacctcggttcgaatccgagcagaagcattttttttttcctttttcaatttttctgcgttttttgttccccaagccctcagcttccaaacagcatcctgaataccggggatatatggcctctggcttcaacaaccatagagccagatcttccgatctagttcctacctcccaattattagcctcgtcttgaagctttctcctttatgacggatcgtaaaagcacaagtagaccgatatccgcctaggtatgtcagagtgggtatggaagatatcaccccgcctgttgatctgcatttgtttcgcatcacggagaggtcatagctggctgagtgattcaatttccgttgcacagcccggagagcattacactttacataatcgtagaagtgcactacctcatgattgggcgtcaccaaaagtcttgggcaatgcttcagctgcagcatccgctatgcaagcacaagcgttcggctggtggactgcgttgggcccaagcttcctgcatactgcactgggcaagctgcctatccgggtgcgtcatgtaccgagtggaaatttgcttgtgtaaccgagggtggaaacgcatcgataatcttcttctttgtcgccaacccagctggattcgagaggaggcactttgtttgtccgctgccgtgtgtccaaggcggagctgcgagatgtaggcatacagatgtattttgttttcgccattggaaccgtgagggaacagcgggaaaataagaaaggagctgtggacagagacgtcgtgtgttgtgtgacattgatgtttgtttcgtgtgtgtgcaccgacagagcaggaacagacgggcgaataaggcggcagacaaagaactgaaaggcacctcaccgacttcctgatattaggtacatgtacttacctaaagggaaccagcagcattactgcccagagcagcagccagccgcgatgcagatacggaggtctgttcccaagtccatcaccaccaccgaaccaaccacaacagatgcagatccgcgcatatgtccaagcaataaacaattttcgttgcgcacatcgtctgaccgcatattttatttgcagagtcgacaacctaggcttctgatagggccgggctactagtgtcggctacctgcatatgaggtggtacagacattcggcagctcgcctctcctcgaccaaacgattgccttcgttcgacggtctgcaacatgtctatgcatgtattggcccatagttatggccttgttagattgtatttccaccccgctccgagcccagactcgtcggcacagggtcgagtcttcttggcgggagagagggagcctcaactgaggggtccccatccccatcagtggccaccgacaactcagccagcatacatgttcccggtctcttcttctttctttaatattgcttttaagcatgaatcagttgattcatgccgtgttcgtgcaccgagtacaagaacaagactctgccctcctcccggctcacaggtccagctcctgctccatccacacttccatcctcgtctcttctcttcaccacaaccaactcacacacatacatttttctcatgatacggcgcttaattgccgtgtcttctatgcatcacagagctcgcgctcagtgatttgactcgagctgcttcttgcgtatatatttgcaagcacatacgcaccattcttagctttcagctcgtgagccatggacgctctcagcacgggcgtcgagatgcctaccgtcgtgccatcgacgagcgtcccgcccaccaagatcctcccccagattcctacctccgagtaccccaatatcccagctagcgagcatatgacgccgggccagatggtgactttgaccgtgctcgagcgtactggcggctgcatcagtctcgtcgccaccatggccatcttcgtggcctttgcattgttcccacgtgtgcgcaatgtgcagaacacattcatcgtcttcgcgagcgtttccaatgttggcgccagtattgcaagcgtcattgccatggaaggcttggccatggggcggagctctgggctttgtcaggcccaggcatttatgtttgaaatgtgagtaggcacacgccgtactgcaaatctctcctcctcgctgaacaacgtgacacaggttcatgcagtctgatccgtggtggtccctcgccatggccatcaacgtcttcctcgtcttcttcttccgcgccaaacctgaaacctttcgaaagtggtggtggctctactgtgtaatctgctacggaggccccttttgtattgccctggctttgctgctcgtgcggaatcccaggcggggtttggtttatggcgaagcaactgtaagagcaccctccacatgctcacttccagccgtgcctgtgctgacaagatgaatagatctggtgttgggtggatcgggcctgggacgacattcgaatctacacgtactatatgctcatctggatatgcattgttggttcgctcattctgtacttcctagttggctttcaggtcttccaagcgaggaatcgtcttcgcgatctctccacctccaggagccgagacccaacggcagtcgacgacgtgagttccagattattcatcccctttcgtaaaacctttatctacatgcatctcctgacagccaaggtggtaaaggcagctcacagcaccaacaagcaccagatgtccgacctgcccaatgagggcttctacggaaccgtcatcaccgaagtccagatcattcgatcgaccccttccagctcagggagcccttcggaaccgaagccagttcacatgaatcacccgcggaccaactcccccgcctcgtcaggcccctgtgctgccgcgtcctttggcatgcgagactacgaccggggccgggacggggactgcaataacgagcgacaccccgcggcaccgggtcagttcttctccaccgtgacgggcccagacgcgttgccgccccatctccgccgaaagaagaagacttggacgtggtcgatgtcgagcatgatcagtagctttgtcatcgaggacgagatcaagcgggcctatctccggacgagcttcctcttcgcgttgagcgtgctggttacctggatccccagtagtatgaatcggatccatagctggctggctggtgagtccccctttgagtatcatgtagcaaccgcggctgttttgcctctgcaggggctctggaatgccgtcatcttctttgtcacgagtagcagagggatcaagaagggttgggtagagatgcgggacccgagagcgcgaggtgatagtatcagcgtcagcgccagtggtggcggcggcggtggtaggaaggggagtggatgcggcggaggcatcacggtgtctgaccaggaagaaggcacggcgggagtgagcaggagtatcttgcgggatggcactgagagggacagcagtgatgccgatgcattgacgctggggagtgacattgagctgcgtcggatgaccgacccggcagaaaagatgtcatcgagtctttagatgcgaggggggagagctctctccgtcttggtctctggaccggttcgcggccgtaacatcagatctgtaggatgttgtgtaaagatcattgcgagggtgtttggactagtgcaaggcggcaaagcggacaccaaaaattacctaggagggtgaagaagaggataggcagctggaggctgacaaccatcaaatcacaattttttttttttttacaaagacctgctgtcacaaatcgagtgtctagataggctaaccagcccttaattcatgaaagcaatcacaatcgccttgccggtttgtgaatcctcctggatggcggacttctccactgccagaagcaactcgcttacggggacaaggagttctgccaccgacagcagttagcagaggcttgcactaaaccttaacgaagcgaggtctcctacttacctaggtagaggatcttgtaagacatgggggggaggtcattagggccagagaggactggcatccgctccatgccacccggggtcacctcgagcctgaccccgaccgtgcgcttggtgtctgcccatatcagcgtacccctctggccctgcccgtctgcccccgcgggggaactcgatagctcagcgagggagtccctccacaggcggatgacgccgtcgaatacattcacgtgggtgaggaagtacccctgccgcggcgatagcctggagacatggatcttggtgcacagctgggtgaagtgctcatcctcatcgaggtagatgtcctctgtgactgagtcgtcttcctcttcgtcgttgtcagctgaggcgttgcggcggctgcggcggcggcgtctggtgcggcgctcctcctctgtgatggttgggcggagggatgcatactgctgcctgtcaaggagactgagggacgaggacaggctgtgctcatcagtgctttgagtctggggggccagattcttgaccccgaggaactggcacgcgagggatggggtggttagcctggcgctgggatggtagcattcaaacacgagctcgtggccggggagggtgacggcgtcgaggaggcggcggcggatggtctctgcgacgatggagtggaagcggcggctggtgcaggcgatggggatgagctcttttgcgaggaagttggtcaaggtgagggcgaggatctagcgatggcattaatgatgtatagattagagagagtgggggggggatgggatctgacttcatttggaagatcttggactgaggtgctgggggttgctggagacatggtgagattgggatgatactctaatagacggtgtagatgagtgagggggggaatgttggatgaatctgattctctttgagtgtatttaatgattatcgcctggattgactctgccaattactatctgttgacttattcaagaaccccgacttttgtggaacccacactccggggatgcggaacaagggattccctcagattggcctattggatgatagatagcgttgtttggttatcttgatgacagagcaaataggcggatatactcttgggcggaccttgctccttctagttgtatgtagctaacggattgactaggtggctattattttgcatgacggaatatatcgacattggaccatatagcgccggcccccgcgatggggaatgcagttggatagtccagctagctcaaagcgattgtggggttctctgtcagaggggctgttgttatgaggcaaagtcagcccaatattgctgaatgtctatggcatctcaagtggagtcgtgggagatgcgtgattccgccacaaatcgcccagcttagctatgtgtagctgttgacgaaaatgcccgctggtgtacctccatggggagccaaacggattccctagattctgaatggagcagatatgaccaaaggacctgctgtccggatcaatagtcaacaagaattcatttcaaagctcacgcgcagttgcgagatcggcaggggtgtggctggggagatgtagtggagtctcgtgacgtcttcggcctgtttcagcaggtcgcattagtggcgaaccagagctcgcgataacggcccgcgataacgagctgcactgcgcccgcctcggcctaatgaactcagtacgtactgtcagcctgcctgccagtgccgaacctacccttcctcctacatcttgttcattgctgcgtgcttcttccatcagcaacccgcaaccactacatcgcccttttgttgtatttcagtctcgcatcatgaagttctcacgggcatctctcctggccgcgtgcgtccccgccatctcggcccgctatctctcggccaacgagggcgataacgtcgtcctcaaccccagcgaggagaccttccttgtcgagctggcccccggaaagacgaaatgggtcaccgaggaagacaagtgggagatgcgccgtaatggccagaacttcatggacatcaccgagacccagaagctcggcacccagcatgtggccgccagctccccggtcgtcttccccaagaaagccgtccaccaagcagaggtcaccaagctctccaaggacctgaataagaagaacctgcaggccaacctggagaagcttactagcttccatacccgatactacaagtccgactacggtcttcagtcctccgactgggttctggagaaggtcaacagcatcatcaaggaggctggcgctgacggcacagtctacgctaagagcttcccccacacctggcagcagcactcggtcattgccaccatccccggccagaccaacaccaccgtcgttatcggcgctcaccaggactccatcaacctgtggcttccctccatcctcgccgctcctggtgccgacgatgacggcagcggtaccgtgaccatcctcgaggtcttccgcacccttctcgaatccaagggcgtcgttgcgggcaacgctacaaataccattgagttccactggtacagtgccgaggaaggcggtctgttgggcagccaggccatcttccagcagtacgagaaggagggccgtgatgtcaaggccatgcttcaacaggacatgaccggttacgtccagaagacgttggactctggcaagcccgagagtgttggcgtcatcacagactacgtcgatagtggtctcactgccttcatcaagactgtcatcgaagaggttcgtttcaaaccccatctactaaaccccgtcaatgccggtagctaacatgtgctctagtactgcggcatcccttgggtcgagaccaagtgtggctacgcctgctccgaccacgcctctgcttccaaggccggatacccctccgccttcgtcattgagtccgcctttgagaactctgacccccatattcactctactgaggatctcatcaaatacctgtcctttgaccacatgctcgagcatgcacgattcaccctgggtctggtctacgagcttggtcactacgatttctacagtgctaagtctgagaacgagtacaatgagctttaggaaggctcttcggggtagatgaggtgagcttggcgccacccttagttctataggcgttgatggtatggttcttggacttcgtgtaatttgttatagcatcttaaactccctagccgttacttttagagaacgactgttttttgtgtggttatatctatccatagatgaatacgcatattacaatcgggtattattctagtttcagtatctatcccatgttcctaccgatatcatctttactcgaatcattcatcgtagcgcccgggtcatacatcggctgctgtcgccgcaattcatatggcactgtttacaagactagtagcttgcttgataactcatcattagtgtttattggcctccctgtggtggtggtggttgttgcccgccccactgctgttgtccgttctgagcctgcatctggctcatcaaggcagcaatgaaggcaggattgaggaatgcaccgttctggggtgcggcacctccttggcctggaggcggaggggcggccggggctgccgcattgggagcctggccgccttggggccaacctgggatctggaagccaaagtttggcagcgctggcacggctgcagcaccgccttggttccattgaggtgggggagggggagcgctgttctgatttccaccctggggagggagggagtagccatctcgggggtgggagcctcctcggccgcctcgcccggaccctcgaccgcggttgcccctgcctctggaatctctgccgcgaccgcggtgtgagcctgggcgatgatggggatcgtacacctctgtggatatcggtccattgccgtagcctgggggtcgagtaagtggtttgtaggggccgtcgtcgtcctcgtcgtagttgagccctccgccggcggacacctcttgtcggagagggtggggctccctgtccttgttgttgttcttccacttttccttctttttctgcttgatcgagcgcttatattcggcctccttctcatcgtccgagaactccatctcgccatcccccgcctcttcgtcgtgcaggttactggcgtccgagcccttcagcttcttcagcggctcggtgaagacaaaggtggcgtgctccgcggcgtagaagatcttggagccctcggccagacccagctccttgatctcgtcttgcgagttgaagtggacgatgtacatgggctgcaggactttgccgatggtctccgcgaccgcgccgatgaccacgcgctccgagttgcacagcaccgagcccgtgtcgaggacctggtactctccgggggtgtaggccttgatgagcatgaggttctcgacgatgtgctccacctctcccagctcctcgatcttcatttcgggggtgatggtgacgtcgggtttcgggacgggctcctcggccacctcgttcttcgtccgcatgtggccggcgcctgatgattttcccttgtcgccctcgtcgtccgatcccccctcggcttccatgaggagccttgccgtctcctcgacgctcaggagctcgtaggcctcgttgtctgagtcctcgtccgacgagtcggagctgctagattccgaagaggattcgtacggcgaggagtctgcctcccactctgggtgtgcgccctgagcggtctgttgggcctcggcggcctgttgttgctctgacgttgtggctatttgacccagcgcctgctctgcgttcgcgggctcgagaccgccgagggcggcctctagagcgcccgtcagggagggagggctctcgggttggtcgataaccattgcgtctgaggaggcattttgtatgttctgatctatctctggcttgtgtgatgtggtttgcgactgcgtcgtggtcgggggttgtgtggcgtcctggatctcgatgtctttggtgtctgaagcggctgatggcgcgctcacggcttggtctgctggtagaggcggtagcttctcatttggcttggcgaaacctaggccgggaatctggaacccagacatcgctgctgagtggtagtgtggtgttcaatcgtcggcaatgaatggatgtaagttgttgcggaggggtctgtcgctggcggcaatggctctgccacagatggcaggtaggtttggtatcaacgatgtaaatgtatacttaatcagaagccttgtcagagaaaatcaattattccagatcctgatgagaaaagagaaagaaagtcgtcaaacgaattttgtctccaaaaaagttgaaaggcagggaaaagtttgtcgcagaaggacccttaaatcgatccgacgccaagttagaaaaaaaaagccaaggtgagcagacgttaagtggggccatggtgcattagctcaacacctcaccgagtcccgttttgggctgaccgagcccaggtacggttgaggtgcccacacctacgtaataattggagcttcagaaacgtgggattcccaacaaatgattcttcttctttctctctctcacaaccctcaggcaaaaacggctcgccatgtctgaccacgaacatgacacggctcgtccggagttccatcatccggaagccacgcacgccaagaagaagtaagcagcggcagctcaactcaaacgacgtccatgcgatcagctttcaattggctaacccaccatttcgctaccaggcgccccagtatatacgcgatcgaaccgatcaaagcactctacattttcgctattgcgaatctagtctcggccgtgtttgcaccgatccaggattgtgacgaaacctttaattattgggaacccgcacattatctgtcccatggctacggcttgcagacatgggagtactctcccgattttaccattcgaagctggctttacatcgctttgtatgcaatcccgggaaatctgagaaggatcttgcctcacccgaacaaagtccgccctctccttaggcccttcttttcccgagttctggctgctaactgtatcaggtggccgagttctactttattcgatatgtgcttgccttgatctgtgctctgtgccagacgatcctgtatcaggtagtcagctcgacaatcaatggccgaattggtgttttctttctcgtcgcaatggtcacatcccctggaaactttcatgcgagcacggcattcctgccctctagcttcgccatgtatatgtgcatgcttggagctgctgccttcatgaactggcggggcgggctcaagactgcccagggcatcttttggttcgccatggccgggattctaggttggccattcgccgctgctctgtgtgctccttacgtcattgaggagtttgttcttatgctgttcagcgaccaggcatcccgttttgattttttcatgagaataacccgaggcgttgtttctgccgtactcctattggtatggtctccagccttttcgttatcagtttctaactgtagttttactcttgtactgacatgaatgtaggcgctggatttcttcgtgaacttgttcttctacaagaaaccagcaatcgtcacatggaacattgtcaaatataatattttctcgtccactggaggtcccgagttgtacgggacggagccatggttcttctacttgaagaacctaacactgaatttcaacatctggttcattctggcccttctggctttacctctctttctcatccagaaactcgcggccccgtcggcccagggcttccaatcagggctgcggaccgtcgtgttcgttgcgccattctacatgtggttggcaatttttaccgcgcagccgcacaaggaggaacggttcatgtatccggcgtaccctttcctggcactcaatgcgtcactctcactccatatcatattaacctggtttggtaactctaacccgtcaacgcttatcggcaaggtaccggcaaagctgaaacttgcggccgtgagccttgtgttcattctctcgctggatatcggtctggcccgtatttatggcatctacgacgcctattccgccccgctcaagatatatgagccgctgtggggaggcgagggcgggcagggtgctgtaggctcggagggtgatttggtttgcttcggcaaggagtggtaccgattcccttcatcatactttttgccgagggagatgcacgccaaatttgtgcgctctgagttccgtggcctcctgcccggggagttctccgaagctcgaattgggtttggcttctggagcggcacgtggctccccacgaacggactcaacgatcgaaacgaggaggatttgggcaaatatgtggaggagcgtatgtgcaccttcatggtagatacccagtaccccctccggaccgaccccctgccacccaacgagccggactacattgccaacgaggagaactgggagattgttcgttgtgaagcgtttttggatgctgccaacactcacatcttgggtcgaactctatgggttccggagctgaccataatccctgacaagtttaggcggaaatggggtcggcattgtctactaaagaggaagagataagagcccgacggcagagatgagtagtcatactcgtgtcccgccctctgcttctcttttagcttgataccggaggacatgcttatcccggagagagtagacactaagcgcatttcttaaaacccactgttgaattgagtcgaggttgatccaggtatatcttaccgactaaattttggccgaggcgcggcgccgagagccgtcaacgatgcgggcgcaaagtcctgaggtcattcacaaagggagcatggccaggtcttcgggatcagtatgagtgctacgtaggacaaagaaaaaaaaaattagttcgatgaaacggcacaccgcgaaaatacacaaacctgtattccagactgcgtcagatgcggctaaacatggacaaatgcatgacgactctttctcgccacgtgcctgaacatggagggagcaatacacaccacatctagagacaggttcgatgaccttgtaaatcacaatttcgttttcctattctttaaagacacaggcatttgatgacgcaagaattaagcatgttgaatttaaggtcgcgactggaatgcatccactgaacaggcgacaccagaggctgcatgcagtagggaaaaggtccagccgagccggaagccagcggcgggccgacgacagacattttcctttaatttttctgggggccaaccgtggccgcagggatgatacataaagcttggccaacagggttaatagacttatttaacaaccttagcaatggttcgtattaggatcaccgctgcctaattattagccagcatggaaagattgcctggttcatagggtaagccatctgtaattgttcggtggacaagtacatatcttgttttccagagacgcgactgttgagacaaagcgtagatcatgctctagaagatagaagtcgggtgggtagatacgcccgctacataccacgcagctcgcaaaaggttccagccgagactggctccctgggagtgttgaggcgataaggattcacacacacgggcacaccgctgttgggcacaatttttttcatcttacttgaggaggcatggatgcaaccagacatggatgcaggctgcgagatccgggcggtgggcggacaggggccgagcagaagtggagtgatgcggcccgggctcagagctccgggcttggacccacggccgacgaccgacgaccgacgagtgccgtctgggggggagagagactgtgcgcggcgccaccccgacccagttgctctggaacttggctgggaaaaggtaaagatggggccgtgggcagatgaacggcgattgcccagccgccgaccaagagagatggagcttggggaaatcggtggtcgactggcagaacgaggggaagcgcctcccgatctgaaccacaggaaggggcgggagggacatggcccagtaggagacggttagtgccctccacacactcattaaaggtcggacagagatagcactaggcccagattatgcagaatcgggaggcccattgtctgttcctgctgggcgacggcaacagctatgcaggcccattccgatatccttcagactgccgttgtgttccccgggggggcgccatgactttctccctcccttttctatattaattgcttgacgccaccacctagggagaagtctgcccattgtcatgaaacgtccaagtggtctgcttttgctagcatgtgtcgattccttttattatacttggataaaatcatataagccctgtcttgaccagacaatatcattattgttatttttacccaccctcaacaaattttgtttgcatcctcctcattgacgccattgataagtggctgtctgctttcaattgctacctcgcatttcaccccagccagccaatcagccctctcaatcgaccatcatggtttctaaagcatccaaaatccgcgactttgtcctgggtcccaagacagatgatcacccatccgatctacatacccgcgctcaagaggtcctcgagccagcagatatttttcttgatcaagaacctactgtaggcgagtggatcaaggagctcgctcctacacgagacggttccattcactacctacagagcctattcccgtccgcctcgtggatctggcggtactgccttcgctggcttctgggagacgtcattgccggcttgacaattggcatggttgtcattcctcaagccatggcatacgctgttctggcacagctagaccctgcttacgggctgtacacctcgttcaccggagctgtcttgtactggatattcggaacttccaaggatattgttattggcgtacgtacctaattgctcctcttagcacctagcttttgaccgctgaactaagactgatcgccaccttagactactgccgtgggttccctactcgttggccaggtcgtcacgcatgtccaggaggcagcgcctaataagtacgagaaccaggagatcgcacgtgcactaagccttctatctggagctattatgctcttcctcggtctattgcgtctcggctggatcattgaattcatcccctacatccccatctctgccttcgtcactgccgccagcataaccatcatgtccacccaggtcccgaccgccctcgggatcaaggggatcaacacccgcgaagctccctacaaggtcatcatcaatacgttgaagggtcttcccaatgccaggctcgacgccgcgattggagtaacctctattgtcttgctatttgctatccgcgacttctgcaccatgatggagaagcgccaacccgctcgaaagagacagtggtctttcatctcgtcgctcaggctgacattcaccatgatcctttacaccttgatcagctacctcgtcaatcgcactgaagatctaaacaaccccaagttcaaggttgtcggacatatcgaggcgggcttcaagcaggccagtgtgcctaacttggaccctgacttgctcgtcctcattctctctgagctgcctgccattgttatcattcttgtcatcgagcacatcgccatcgccaaggccatgggtagaatgttcaactacaccatcatcccttcgcaagagatcgttgcccttggagcagccaacctgttcagcccctttgtgggaggctatgtatgcactggctcctttggcgcgtctgctgttctctccaaggctggagtgagaactccgttggctgggctgttcagcgctggaatattagtccttgctctgtacgtcctgacgtctgtatttgcctacattcccaacgccgcactggctggtctcattatccacgcagtctgcaacctcatcgcacctcccaagaacttgtacaagtactggaagctctccccctttgagctgatcatttgggtcatctgcgtgttacttgctattttcgagtctctggagacctcaatctacgtcggcattgccctctccttcgtcatgctgctcattcgcctgtccaggacgaaaggggagttcttgggccgtacgactgcccaggaagtcgttggcaataacaacaacactgcaagcggccaagagtcatccgataacaaggattcgtgtctcagtggcagtaacgaggagcgcgaattatacctgccactgagtcggaacgatgcgtccaactctaacatcaaacttgaaacgccatacccaggggtgataatctatcgctttattgaaggcttcaattacaccaaccaggcgcttcacatccgccacatcctcgagtacgttgaggcgaccacacagcgcacatcggaagaacatttcgagaagaagtcggaccggctctggaacgacccaggcccaaagacgcaaaagagtgcagaccttccattcctgcacgcagtagttttggatttctcatcagtcaacaacttggacgtcacgtcggtccagggcctggttgatctacgcgcctccctcgacaggtactgctccccagattcggtggaactgcactttgccaacgtccataaccgctggacccgtcgcgcactcacggcatctgggtttgggtacccctcctcccagaagagcgatgccattgcctgctggcagccggcatataccattgccgccgtgctggacccagaactgaatgagaaccgtcccaagaccgacctggaggcgaatgagacctcacacactgacacggaggccgagacgattgcgccaacggtcgcttctacaaattataacacaattactcctaatcagcctcaggagaagcagaaaatggctgccgtgcatggcgttgaccgcccattcttccatgcggacctccacacagccgtgaaagctgcagtgagggatgccatgaacagagatgcaaggcctggaccggtaatggagtccgactaatgacttgatgatgaagatgtattgatttcaaggatggcgttgggggcgtttgctttcatattagagcgcgcgcgttgtttctattatagatgggtttagactaaaacattggttgacaacattaatacactggtagtcttatgttaacgctattgtctctcgccttccagctttgcatcgtgaatatgtttttgtgagttggaaccgcctccatatttcaggagacgttctgcgggctttcggttgtgatgtctttgataaaaacacgacacagcctccaaaccggactagatgctgggacaggcgtaggtgggatgtgagtcttgcccctgatgtgggagcattcatgctatgttgggttatttttgctcagcatatttcaggcactcgatgagcggcgcatgccaaggccagctggtccacacaaaagactcttttctatccaaataccggaatgagcatctctcaagatgatccaccagaggcggctcaagtcggctgtgcaggtggcatcggtgagggggccatgtgaggcgattgaatgccgcgaccctgaacacttcccattaataaaatgcggatgaccatttctcggcatcacacgtagcatatggccaaagcgcaagatttttccggtctcacagagagactgacagcgggaacagcttactgctctctgctcagatccccatgtcatcatcgctcggctcatcgtcatcagcaccgccacgctcctcctcctcctcccgccgcgaagcctccgcgctggcccccagcttccgcacgccctcgaccacgcccgtgacgaacccgcgactctcggagagctccatggccccgactcccagcaggctcatgacgccgtcgacgccgctctcgagcccggctatactggtcctcatcttggcggcgcggacctcctgcaggtcgcgcaggagcgaccggacgtcggacgcggaggggacgtcgtcgctggcgtgggcgagcagcatctcggcgaactcgaaccagtggtacggcagggcccccgcgggcgcgctggacgtgcacgaggggagaaagggcggggacaggacggtggtcgcgtccgagttgagtctgcgcgcgtttcctctgccgtcggctcggacggggggcggcggcggcagggaccagcccgtggggtcggtgacggtctcgtgatggatcaggtcgcggagggagtcgacgtgcagccagggcggcggcaggatgttggctcggcgctgcttcttgagcagcagggccagccagagtgggatgtcctctcggcgagggggccggagggagggcgtggctccctacatcgaggagcgtgtgagtcttgatgtggtggttctctgggagcgcgtcgttcggtgtggcgggggaggggcacgcgtgcttaccgagaggagctcaatgctttcgagtctttgcctgggaacgattgtgacgtgttccatttcgcataggaaagctacttcggaagggaccagccctggggggagagggagcgccatgttgtgcgttgaagcccttgggtacgacttttggaggtggagggcttgtatgtgacgtttttagtggtggtggtggcggtggtggcagtgacagcacaccgacccgctcctcaccagcggcgtttggtactgcccctcgcctcgcctccagcttgctcagtaccccaccagcccactaaattttctcagctggggcttgaggccaacttggataaagtaggtagtgtggtattgccgactcccggcaccaaagtacctgcccaccgacagcaaccaccagcccaggccaatcagtgagaacagaatccttccttcccgttattagactcaacggctcgctagcttcccatgaggaaggtgcatcatggtcggcctcagtgacgtagctgctcgcaactgccatttctttcacgaagtttgcgcaattgaccaatgaggtttccgtagttattatgtattataaaagtaattttccccgctaagctaaatcaaatatatgcatccgaaacataacacatccaatcctcccatttccaatagaatctaaaaaattgatggcccagcgctacccaacatatccagctcctgtccgtgattggcaccatgtgtctgcagcatcaaaaaccgtatcgacttctgcagctcccagagcatcgcgttctcgacggtaggccgcaccggtcgaagcccccggctcctctgcagctcgtcaatcattcggcacccattgtagatgtgcgtccttgcggcaacctcgtctccgtgaagcatctcgaacacgacgaaaaataagcagcagacggtgaccgattccagatcgccgcttcccatcgcttcattcctcagctccgccagagcggagccgtgatgcctcagtgcccgactgtaagcattgcgaccctcctctgtgaaagcgcccgtcatgttcgacctcagagactcgatcagggcatggatcgccacattggcggcccagaccgatccgttggttcgaagcatcagcgggacggttgtgctccagaaaacatcctgctgtccctgggtacccgccattgggggggtggtcatcgaagccggcgatgatccaggttccatggggacaacggtgtgatttctgagatacagaagcctcctgctctcagccatcatggcggggtaccaagaaggcagctgaccctcggattcgggtgatgtggggattcggggactcgtttcttcgctcgctgagctctgggcttccgattcctggttttcgctcgctgcagccgattcgggtcgcttttggtagccctcgcactggcctccccatttaatgcaccgctggcaggcgggcttttgctcgtcgcatttcacatgcctccgcttgcctaattggtgtcaggatgggacgaaagagaaaaaagtatgtgggaaatgaggtggttcactcacaggtaatgcatccagtgcgaaccttcttcacaatcgcccgagtggctcgtggtcgattcttgagggcgaaagtcgaggttcctgcccgactaactgcctcggaattggccctgtagagcaattggttaacgaggccatccagcaagagattcggggaagaaagggccaattcccagtccatacatctcacaaaaagctcaagaaaagaggagggggaggtgggtcgtgagagactccagacgattggtaaggtcgggtcccagcaatgatcttatagatctgaggatccgtcgctggcgtctaagcctggtcttgggacgcggttaaagagaactacggtacgattgatggcggttacgtcaagagtaggggacgataagttcatattatacttggcgtctaagcaaagcttcttttcagcttccaggctgttgatagtctttgcggcggcgcggctggacagtccccgggctgacgtccccacccgagttgcatacttttagcaaccaaggccaacccaccgccatcgcgtggctgtagatgtgttgatgggaggtacgtatctggctcgagcttggcatcttaccccagcacttcgcttgttcccttgctttatcacagtgggtattagccctacactcaggcatagccccacgggcagcgaaggggtcgtcacctacaggtcgccgacctgctgggaccagaactgagggtgttacggtgcaaaaagtcgggcactagtgatgcagaactgagtctgcctgcattggcagacaggtagctggcccaatgtggaaagtgacgccagcacttctccccaccccatgggttcagatgctctcacgagttcttgcatcgccgtcccaattgagtcatgcgagaagaggtgggagaattgtccgtccaggtcgtttgccgtcattcccagcagagcaattctcatgcaccacccacccagcggtgagagtccaaaataggagctgccctatcaggacacatctttcaagggcagagctgaccaggtcgccagcccaaccctcccgacgttacatgaataggcctacagccagagcagccgccggcgctaagaggccgctacctgtgctccaggcacatcacataacccattactcacggctcctaggcagggggccgaagccactatcccgccaaatggtatatgcgggcctggccttgcgactcagcctcagccctgcagcccacaactgagcaagattagaactggcatacggcgactccggaatctcagatatacccatgcattgcatcatccccggtgcataatcgtgtacccgatgttgggatggatatcccaccaaagtcgcgcagagggaacgaagcatcgagagaagcatctcgctttgcaacaatgatgagactcaccctggcttcttgtgtgtgagacgatgttccatccgcggtctgacgcataccgtccactatcgaccatcgaaaaggcggaggtgatgaaaacaaaaattttcaattaacgcttcaccagaacaaccaccgccgcaatcgagccttcagccgcttagactaagacctcaagagctgccattgaatgagtcccgcctacttggttccatctgccggttagagttgatcttcggtcttggtgtctctgatttgatgcgttcattgggccaggccagaggccattccactcacatcccacatcccttgacagcaaaccggcaaaatctaatactacgtagtaacgttgtaaggtggatccaggattcgggaggctctcccggcggaacccaaaattctgtatcgtctaagagggcatccagtcatgcacgcacctaccacacgacggctgcattggccagtgatctacgtcaatcgcgccggggccataggacgtctcgacttggggccgtgttggaagtacaaagccgcattggcacatctgtatgtagtaggtaggactgtccagatcgaggctcttctgagatctgggatactgccggcgagcttggcgcagcctgtatagggcaagatccccaagcctcacagtcgagcatcgcgaggctccaagacaacactcgacggcaatgatggcgagattctattcgtgttgaacggcgaatatctaatttcggagcagatcgtaattattttcacgatatcttgtcgttcacccctgctggcgccggaggctctgtgcttgcaggtcatcaattgttaccatcattggaaaaagaagacaaaagtccatcacctctatgtttagtcttgaggctcaacacgaggcataacgatctcgcgagcgtgaacaaagtgccatgaggaaaggcatgatccgatcacaatcccggcgccactcgcatcccggccatctccagatggtcaacgctacgtgacatgaatctcacaagcaaggtggctagtgagtggctcccgctttgccacaggcatcacatcggcattaatagcttaaatataggcacatagctggagtggcaagctcattggccatctgaggtcgccgacgagccacagcccacacgcctgagaataatcaattgcactagcgagcaagagaaagacaataatatgcacgtttttgcttgtgccattcgtaaatgcaagccacagtgggaacccggtccaatcattgttgattgccatgcgatgcgggctcggtatgctacgtagcaggtcgggtcagatagcccttgttggtctccatccttcgaaaaagttccagaacaattccctattcatcaagccacctgcaccggctcacggcagattacctccatctgccacctaccgacggccaaacagtctcactcaaccctgaagtctcagtccgttgatccagacccctggcacgatgccccgagagctcatcctggccaaccccacgccagacgaaagtcggcagacctggacgtgcacgcaccctctatggggcgctgcgctcagcctcgatggatatatcctgcgcgaaacccgccaggctgacttgcccctggcccgcgatggcggtttgaggccctgggtgctcgtcgaggcagactcgaagcccgattcacgcgacatcctgtcgtcgtgcgagacgctcaggaagcgcgcgcttgtgaggcgacccgacggcgaggtcaatgaggtcatcgcccacggcgtggccagcgtcttcacagatcccgccttccggggcaagggccatgccagcaccatgatggcttgcctgggcgaggctctgcaggccgagggtgcactcctctccgtgctctggtccgacatcgggaaagagttctacaacaagcacggctggaggccgttcgagagcgaccatctcgaattccccgtgcccgcccaggagaaggaagacgaggacccctccccgcgaccggccagcgtgaccatcgtccggtacgacgacatcccccagctggcctcgtcggacgagcgtctgatccgccgggccatcgcgcgaccacccgcctccccagggaagacgacccgcgtcgccatcctccccgacgcggccaccctccagtggcacgtcctgcgggacgcagcgcagtgcgagaacatcctcgggcgcacgccgaccagccacggcgccgtctacaccaccccctcgggaaggcgcgtctgggccatctggcgccgcaaccactccgcgccgccctcgcagccggagaagaacaccttctacatcctgcggctcgtggtcgaggacgaggacgaggccagcgtcccggacgacgagctcggcgcggccctcggggccatcgtggcggccgcgaagagcgaggcgcgcgactgggcctgcgggacggtgcacttgtggaatcccgagccgagggtacgcagcctcgcggaggggagcgcaaagctcggggccaggttcgtgagccgggagagcgacagcgtcaccagtcttcgctggttcggagacggggatgtcgacaacgtggagtggctcgccaatgagaagttcgcatggtgctagggcaagcagatagaggtacgtcagcaaagaaaccacaggatgagctagataatagactactatgttgtttattgtcttgagatctatctggtgtcgattgttttactgtgttggtgatctgggtgcaaccatcttgggtcgcatccactaggtcacgtctacaggcgatacgaacacacaaggacatatttacagctggcaagcacggtccgaaatcttggtctcatcatcataacattcactatcttgttcgccaacaccttcccctaaccttaaactaaacacatgatacctggagagcgcccgtcgctccattcgaaaaagccaaagcaaccgtcatgatgaacaagaatgtgaaatgaggagcttagtagcttcggccaaacatgacccacttttgggctttacgctcgcactcggggttgagacactcagtctcgcctgcaacaacaccctcgggctgctcgaagggaatgcagagactcttcatgcccatggcaggagccttttggttttcagggacgtcaggctggttatcctcacgggttgtgagcgccttgatgcggtcctcgcacttgccgtcgagacagaagggaataaggacaacgttcttgttgtcgagagcggggaggacctcttcccacttggtgatctggatacggtgctcccggaaagcggcctcggccttggtatacatgtcgttctggatggtctcgagcaactcggggaccttggtgccgacctcggagatggggatggtgcccttctcaccggtgtctctgcgggcgaaagagatgacctccttctcggcatccttgaaaccgaattcgattctcaggggaacacccttgagctcccaatcgttgaacttccagccgatggtgtaaccctccctccagtcggcatcagtgcgcacgccggccttcttaagggtggcacggatatcctcgatagtatcctcgtgcttcttctttgcctcaggtgtagtgttcttgttgataccgatggggatgaaaatggcttgaatcttggcaatgcgaggggggagaacgagacccttgtcatcaccgtgaaccatgaccatgactccgatgacacgtgtggagagaccccaagagttctgccacacgtggatatgagatcccttgttggcggggtcctcaacggtgatgtcgaacatcttgctgaagttctggccaaggcagtgggaggtagctccctgaataccacggccgttggaaggaatgtatccctccacagtggtagtgtagtaaccaccggcgaacttctcgttctcagtcttgcgacctcgcacgacgggaacggcaagaagttgctcgtagacgccagcgtagagctcgaggatctgcagtgcctcctctccggccaactcctcagtcagatgtgcggtgtggccctcctgccagaggaattctcgtgttcgtaggaaaggggtggtctgctttgcctcccatcgcacgacggagttccactggttcagtcgtaaaggaagatcgcggtggctgcgaatccacttggagtagtaggggtacatgacggcttcggaggtaggtcggatcgcaacggggacttcgaggtccttgtcaccactagagaaacaaaaattagccagactgcctgatcaagatgtccaagcaccattacgtacgccttggtgacccaggcaagctcgggggcgaaaccctcgacgtggtccttctccttctcgagcgacttggcggacaggaaaatggggaagctggtctcctcgacgcccatctcctcgatgtgttgctggaaccacttgcgaatagtggaccagatgtgcatgctgaggggtcgcagcacgaagaagccagagatttcctggtagtactcgaccatctctgactttaggacaacctcctggtaccaggctgggaaattgtcagccttggagacggtgatgcccatgatctcctcagccttcttgccgccgacgacagggagagcggcctgcttggcagctttggcagccttgtcggcggccatcttggcggccttctcggccttcttcaaggcgctcttggactgctcctttggtggttcctcggacatgttggctcgcaggttttggtgtgccttgttgtctcgggtgcggggcaaaaaaacaattttggtcctggaggggcaatgcaatggggatctatctctacggggagaagaagtctaagtctagaaagtgaggagggggcgaggggagtttgacgcgggctcggcgaagtgcacagatgactcaatggaagggagagcgcaaatcagagcaagacgcagagggaggagctggcagaaggtatgagtcgacgagcggcccaagacattgggtgccctgccccgcagtcacaaaccgtggccgagtcgtgtggcctaaatcgacaaatggaggggcagtcttatcgccaggggtccgtgcattacaatgcatgcaacagcttcaagagacgagcattttgtcagggaaattggtgtctgtttcttttcttttttttatgaattatcagataggtagccatcagaggtacacgatgcatcatctgttaatgttcaccagagctcctgcccgctggactgtgcaagttcctccgatgaggtaggcaccgggtagccttccgatcccggttatacctgcctttaacttgcctcctcaaaaccccacgttgtgtctagcagataaatcataccgcactcaggcagtctagccagtcccacaattcgggattctgttattcaacaacgcaaagggcccttcatatcgtatgccctcatcgattcctaaaatagtacgactttggtagaaagtagacgacgaagcttgtcgtcctctttctcaagtggagagcccattcagtcttccatgtgtgctattacatatggaggttaagttcgcaggcgactaggtaattcgaggagcttttcatcttggttgcggagtgagatcctaggtcacatcgccgttgattgtaagaagctctcttctgagaggttattcgcttggtacaagtaatgctgccgccgtctctgaaattgaaaggtatttggaactgctcgctttgtgttcggcagctatgagacccgtcgctgcttcactctcgtggtgaccttcatcagcccgagccagaaagctcatgccgcatctcgttttcgtgatatggacctcaatatcctctgccccatggaaatctatttgattactagttgaactaaacgctgaatgcgtctggcaggcgtagcggctagtaaggtaccaatttgaagctcagtttttgggtttttgcatactccctacctagagaaaactggaagcttttggttctaagtctctgctttagccattacaagatgtcgggctaaaacaatactaaattgcgttcttactcaagagtttgcctttccattccaagaccctcatatctcactgcggactagaatcaagcacaatcctttctcgttggtcttgtaagtgcaaaaaggcaacaacgaaaaaagccccggcgttcacttccgggattccgttttccagtgaggctccggtatcatgtatcaaaggatcgtttgtgcaagcccctgggcaacgaagatattatgcaatactgtatctatggccgtaccacatcttcctggagggggcacatactaggtgtatatctatcatgcaatattatgattctattaacagtgtagctcttaacggccttgccaagaaggagtcatttcctttattgctctccgagaaacgtgcactaaccacgagtggcactggagtgggagaggtaggccctgcatttaggcatcacgtcgtgtgatccagggatggccaacaccgcatccacgacagtaggccaaggtgggaactgagaaagcttggaacgtgtgatcaactttgaacccccggcttgctattactaggccagctttcccggccctggctacttcgaaagtggaagacatgttggtaagatttgtagagagaacctcggtcctaagactgcattagtggcaagtggaaaggagtggactcctcattagtggggttttgagggtgtcgtgatcttgactcaactccatctgttcagccttgtctgacggttgttggtagagttccttcacgctagcaaaagaccatgtctcgggcaagaattacatggttttaagcgacgaaaggcgtgaaatagaagaaacaaacccctcacatacccgaaaatagcatccacgttcattagacaagagtctcgtgagacggtcagaattatgaggctagcaaccaacaaccaaaaactggcggagctagtccacatcacccctgctattattaggctcgacttgaaggagaacatgaacctcagaggcaataaagggctcctggacgatattcatagtgtaaattaaatttgagtattcattcccatcatcaaccatatgaaatttcgtctctcattccctgatgctgagtaaacgtacccagccatgcttccctaccattatctgtctactatcttgtgcttggccttggtggttgaagccggagataatagtaaaaagatttatgcttcatctatgagtaactctgaagagattagagctagaccccaagatgatgcaaatggtatactgcttcaagtaggttcaaaacgcctttttgagacgagtgctcatactaatttgaatcttggtgcaaggatccctttgttggcatggccattgatagaggtcaagctctagacaaaagcgagattacaccccaagtcaacgttatcgtcaaacgaaaggctgcgcccaaggctgcccctaagaaacctgcccccaagaagcctacacctaagcctgttcctcagaagcttgtcgcaccgaagaaaccagcacctaagaagccagcacccaagaagcctacacctaagcctgctcccaagaaggctgctcccaagaagccgatatccaaggctgctccgaagaaacctgcaccacagaaacctgcaccaaagagtcctataccaaagaggcctgctcataagaaggctaccccgaagagacctgctcctaagagacctgctctcaagaagccaatatctaaggccggtcctaagaagccaactcccaaaaaggcctctcccaagaagcctgctctcaaaaaacctgctcctaagaaggccgtctctcggaagcccgccccggagactacagctaagtctgccccaaagaagattggtagaaagcctacagctaaggctgctcccaagaagccagctaccaagacatccgccaagaagcctgcacccaaggttgctcccaagaagacatctcccaagaaagcagcaccaaaatctcctctgaagaaagaggcttcgaaatctgcaccaaagaaggctgctgccaagaataactttggctataaagctgtaacgcataaggaggccctggccaacttgaaggcattcaagaatgccgctgctcggaaggcggggtctaagaagacaccacctaagaacgcggcaggcaagaagtccatgccaaagaaaatccatgccaagattaagtcaggtgctcagaagggtgccaatctgaagaaaaatggcacccccaagaagtctgtacctaagagagctggtgctgggactagagccggcgccaagaagggtgatggtcggcctaaaggcaagaaagcttcccccaaggccttctccaaggaaaagaaagctactacaaggcggccctcaactaaaatcaagaatggggataatgggaaggagaagaaggcttctcggggcaaacctcttggtaaagggaaagcattttccaagaataaggttgcttccaagggaagttcccctcaacatgctttcaagagcaagaccgcttccaaaggcaacgctgctactaaaggaaagaaaactccaaagggcgtagctacccagagcaagaaccccaagaggaagactactgccaaggacacgaagttgcgtaaggttaaggctgccaaccggaagaagactcccaaccagaagaaggctaccggtcaaaggaagactgccaataggatgaagtctcctaagcggaagaatgctatcagtcagaagggtgcctctaaccggaagaaggctgctaatcagaagaagactacccaccagaaacctgccaacaggaagagttctgtcaacaggaagaaggcttccaaccgagagaaagctgctcacaggaagaaaccttccaatcagaagaaggcggtcactcaaaagaaggctgtccatcggaagacgccttctaaccggggaaagagcgccagacagaagaagtctgccaacaggaagaagactctcagcaagaataaggcggcaagtcaaagaaaaactgccaataggaagacatcttccaaccagacgaaggcggccagtcaaaaaaagactgttaatcggaagaagccttcgaaccggggaaagggcgccaagcaaaagaagtctgccaaccagaataaacctgcccgtcaaagaaaagccaccaataggaagacatcttccaaccagacgaaggcggccagtaaaaagaaggctgttaaccggaagaagcattctaaccggggaaagggcgccaggcagaagaagtctaccaaccgaaagaaggcactcaaccagaagaagtcttccggccgaggtaaatctaccaataagaagaagccttccaaccagaagaaggtttttaaacaaagaaaggcggtaaaccggaagaagactgccactcgccataagcctctagcaagcaagactactaaggccaagacagctgtccagggaaaggcttcttccaaggggaatgttgctgcaaaggaaaattctgtatcatctaagtgctcttggcggcgatctcttggcctccggtgcgaggactcggacggccagagaggtgaaggagaaaatacaaatggaagcggaagcgcaaacaacaatgaaccacggccgcagagaaaaacgcgacagaagaaagtcaacagcccagatgctggggacgacctggctgaccaactcggggggttgagtatcgatggcaagaaagacaaagggaagcagaaggaattgagtaagaaagaggaggagcaaaaaaagaaagaggaagagcgaattaagctggaaaaagagaagcttcaggagaaaaagcacaaagtagccagactcaagaaagaggacgagctcgtgacgaagggacactcgaaagttggcttatctgatgaccgccttaataaccatccgggtggctcaaaaggagatcacagcatgtacctcgcaatcactccaaacccgtttcgtaatgacgatgagagagaccgaatctttgacgtaaaggggcagccagtgctatatcaaaagataggggatggccgggagtcgcgagttgagggttatcgcacagaaaatccaaactttgcagccgcagtaagtcatggacaattaccaatattaaaagatggtaatgaaaatgtcattcgccatcgcccaggcaaagaggaggagaaatcgacttacaaggaaaacgagtaccaagaaggaagcctcccgaaaaaaggtaaatgcctccactctggctctcctccctggttgtgcaagctaacaatgtattgtacccaggtgatatcgagtttaggaaatatactgcacgcacccaggcagaactcgatgaacggaagatcaagaataaaccctggactcatgaggagatggagaagaatgcgtaagattcccatatccacctcgtcgctcaaggcctaggaaaagctgagcctaacatcgaatcgcaggcgagagaaattgaagcacataaaaaatcataaggcaggtgataagacttctgagtggtataaattggagatggagagtcagaaaatgtgcaacataaaaaacatcaaaagcgctgacagctatgtattcgacggtggcatgccgctcgagaacgatgcggattcggtcgtcttgccttcggatgatcagaatccggctggtgaggattcggctggcgaggattcggccggcgaggattcggctggtgagggtccggctggcgaagattcgggcgatgagaagtgggaagattcgaatccggatgacgaaagttggaatgattcaggtgattcgagttattacccgagttccaactagcagtgggtcaataccaacgcggttcaaagaccagagagggaatctgctacatgaggaaaaagagaggcgggggagctttgcaagctgtcataacaaaggtgggaaatattctgatggggccaggaaccaacatgtaagtttacgcattcgtagctattcttaagttatgtacaggtagtcaacaagcaattcctttactcctcaacgtgttccctaatctctctatgcctggtctcctaattataaactatggctaaaagcttggcgagggacatattgagctgtgggttcctcatgtcactcaaggtgatgttgttgcctaacgaaggattggtgtggcgttcatggtttattgggatattcttgtctgggtagaccatgagtattctaaatttggacagttcagcaagccacgtaatcgatgacgaaatcttcttcactttcagattcagctcaaacctgatctaaagactaccttaatccccatgctcttctaaggcatttgcaaggtcaggttgttatggtgccgtctaatgagtcaagatccacgccgcctattactcttaaacgctcaagtagccctcattctcaaaaccagtcaggacacgttctgaccctggtaagacgatacgacggtcgatatctggtgttgtaatgtcgccaacacgtaccaagtagtctggctggtgatggttcgtccgctcccctccatttccgcgccaccaactctcagtctcccatttacagcgcaaggcacgcttcttaacttcttctttagtaaactctagaatttctagatgagcactatcaatatccacgctggacatgtggaacattctgcgtcgcgtgccatagtccactttgcctctcttgttatcgtcgactgatttgaagtggtcaagaaagttctcgatggcagcctttgccgccgcactcgtctcttcgcgcacatggtgcaaatgcaacaggcggcataccctgctgttggcctcgaccaggagcaacatgtcggtgtcgcgtacatcgggacgaaattccggtgtaataggaccgtctttaaccagcacgtaggtgtagcttgcgaatggccgcacatcgttctccatgaagagtggtggcggcgagtccaagttgaacatattgcaataccgtgggctaagaaaatcagcaaattatgcaatgatatacaatgaaggggggtttgccacttactcatccagataccacagtcgctcaggctcgtgccacatcgtgtgattccaacctttggtatcattatcaaaccaacaaacatatgttagcccagtgcccatacgccgctgtctactgcctccttcgtagctagactcatcccaatggaaccagaggccacggttccggctgtgctccatcatagaagcaatgagatttttgtgaacgtcgcagtttgccctggtcactccaaacccatttcttgaagggtgtgtgtcattacagtagccctttgactttgacttgatcgccttgacttgttcgtagaaggcatcactggcactccgaagctcggcgaccggattataagattggccctggtgaatgttgtcagggctgttggataccagtttctttgggtacatattgacggaagtatcgatcttggccagtaaggaagaaagctcgtgaacatggctcatgacagccacgacttggtcatccatatccgcataaaccctatcaaacatctcgaaaacggtaccggaagtaccattgccctcaccaagcggctctatctggtccagaaagccattgacagtagcttttgcctccttgagtgtgtcatcgcgcacatttttcaggtgtaacacacgcatttggtcttcggtgatctcaatactgattattatgtccccgtccacgaagtcttttcgctcaagccgaagctccggggggtcagaacatccgcgagccagcgagtatgtggtgcttgcaaacgacctgagggcatcggggcgagcgtggccttccggggcctcttggggaggagtaggggggccttcctctgccattgggggtaataaaaacagaggctactgggactcctgtagagggtatttggaaagagaagaagggaacagctttgctcacacttgttgggggccttgtagaagttggctcttgaagattacgctgtagtcctggctggcttgcggatgccaactagttagttgcccgttggtcctttcaacagataatgtacctgggaaaggcagacgattcgtgtcacggaagacgggacgaaggagtacctacatacattagctagggtgctccaacaatagcagcccattgagatgcggccccgccttgatgcatctggcataatccgctaagtaatgaaatggctgagacttttggtaattcgtcagttttgactttcgattctgtcattgagaacttcgtttgttggtgggtcggagctgctccaaatgccccccagctagagcgggtagggctgatgagacaacatgaagcaccatgcaccattttctgggatggaaagaaacaggagaaaattacacttcccattcatcaatccaacaaggcaccaacaatcggaacggcgcactgcgaaaacgaggcgtaaaactactcgaccgaaaattagcaagactagcaggggcgatgcagactggccccgccagttgttggtcgtgctgggtgctgggtgttggttgttggttgttggttgttggttgttggccgcaaactcctaaccgcatggagcaaatgatcatttgaatcgaaagttgcctcatcataagccccgtaaagagtcggagaagtcggtgaaggggttggcctttgagttatctccgacttcttactgagcttttcctagaagccgtctttgtgatagcccaatgtgtaggtttccccgatcttgagaagaaggcttggttcatcatcctatcacttgacgggtctatattgggttccagagctcctattacaattgtttcctgatgaataacaaggattctatactttggtaaggaagtctctctagcccagagttctcaaacctattatcggcttagtccaatctcgccctttagttccatcgtttccgattaaaatctactttttgttcagcactaattgttataacttgaattcgaacatcttggtcctggcctatttgcccccgtattgcaacggctgatctagtcctaagacggacctcatgctggtggatttcttggcttgcgattatttcccatcagaaccaacctcaaacagcaccttgctcgcgctttgctttataatgtttctttgcacagtctggagctcctactctaggctcatagtcgtatttatcaggtggtgtcagtagcgctagaggtagatcactatcctataaagcccttgatcggtccctgaaaccccctgcaggttacccaattgatgtttgttgcagtttcaatccacatttgaagaacaaaccaccgtagggagcggttggaatggttaggggctgaatctgtagtcgctctattattcgatttccagtacacggggcgtccgtttagatagaagacaacgcaatgattccagagaggaaaccaacagagggaatgaacggtatatccatctgagatatatacgacgcacgtcatttataccactttcaatccaagaggtaggtatttctactttcggtattgaacaaatgattcacgctgtactgatctaagagatgtttttgttcttatttcttttctcatcttccaattctggtgttggtgtgtaaattcgcgttgttcgaagatttacaagtagcataatgtgcaaacgttgcatattgcttatagactaccaggagggactgatgtattcatgggagcatgatctttacatctaacccagctttcattagcaaccagttaatttatcattcagtttcagaaaggaccaagctcagcgtgatatgatgaagatggttaattggaacagcatgaggctacgcagcttcaacgtagatagattccagatccattcatccaaaggactcaaaatgtacactggtacgatagaaataactaaatatgttaaaggaattcagactagaagcctgataattaaccacggcggctattatgagcttacccataacgtaggaggcctccctatcataggtagcacagtttgacctaagatattgtttatctgtgtccctatcctcttaagagcttgtgtcgacttgtgcgaaatcagcaaagtcgccgaagggaaagaacgacgatttctttttttttaagtcgatgattactgacggggggtcggagcttaaggtagttacacatcagtcctttagagaaatggactctcttgatctgatcaggtcaggtgttgggattccagctcgaattacaaggctctgatctcctagatccattaagatttctacagctcatcaaagttaaacgactcaacgataccccccgttcgttgtgccttgatctaacggacgaactatgtaagtcgcattcacatggcgtcgaatgttccacacaccagtccctgatgttggttgtggctatggtagcctatgctcacgtgtatgattgctgccagttcaagttttcgttttggccaagcttttaatacagagataatacgcatgcagttaagtcggcaccatcttagcaaagcagtgcttgagtgctaagactcgaggctgcatcacgaattccatgggggtggaaaatgagccctgtctgatttgctggtgggggttcaaggcagcccaccttgtacctctgtgctgtcgctcgggctaaacccggataggaagcggtgccctgtggcagcgagaccgccttggctccggggcaggaacaatcaaagcacccggcaaaaaaatcgaggggcaattctccatgagggaagctgctagcatctgatggtagcttgtgggatccagacgcccatcgcagacctgcacaacttggcaacctcccacgcacacctacccgaccgaacccaagagtcaccagcctgacccagctttttgggggatatttccaaccatggcgtccatgttcgagcagccccgcaacggcaccttgttcctcggcggccagaagatctccggcgcagacattcgtgatcagaacggtacgccacccacggacgagatggccaggagattggtctttcaggagcacgcctagctaaaacctctgcagtttccgccacgcaagcgatcgcaaatgtcgtcaagagctcgttcggccccagcggcctggacaagatgatggtggacgagattggagtaagtggttccccaatagggagtaggatggccagcaactcacacatcgcaggacgtcacagtcaccaacgatggtgctactattctcagccttctcgatgtcgaggacccagcaggaaagattttggtcgacctggcccagcaacaggacagggaagtcggtgacggcaccacctccgtcgtgcttatcgctgccgaactcctacgtcgaggaaacgaactcatgaagaaccgcattcaccccaccacaatcatcaccggttaccgacttgcgctccgtgaagctgtcaggtacttgaacgagaacgtcagcatcaaggtcgagaacctcggtcgtgaatcgctcctgcagattgccaagacctccatgtccagcaagattatcggtgccgatgatgatttcttcgccgagatggccgtcgatgccatcaaggctgtccagtccacaaataacaagaacgagtccaaataccccgtcaaagctgtcaacattctcaaggcccacggaaagggcgtccgcgaatccgtacttgtcaagggctatgctctcaactgcaccgtagcctcccaggctatgcctacacgcatcaaggatgccaagatcgccatcttggatatgaacctacaaaaggagaaaatgaagctgggtgtccaggtggttgtcgacgatcctcagcagctggagcagatccgcgctcgtgaggccggtatgattctcgagcgagttgagctcatgttcaaggccggtgccaatgtcgtcctcaccacaaagggtattgacgacctaattctgaagacatttgtcgagcgaggtgccatgggtgtccgacgatgcaagaaggaagacttgaggagaatcgccaaggccaccggtgccaccatgctgagcacattctccgacctaaatggtgacgagaagttcgatccctcatacctgggatatgccgaagaggttgtgcaggagcgtatctcagatgacgagtgcattcttgtcaagggaaccaagcaacactcttctgcttccatcatcctgcgagggcctaacgactacactctggatgagatggagcgctcgatgcacgacagtttattcgctgtgaagagaacactagagagcggcagcatcgtgcctggcggaggggctgttgagactgccctgcatatctacctggaggaattcgctggaactgttggctctcgcgagcagttggccattggcgaattcgcccagtctcttctcattatccccaagactctggctgtgaatgccgccaaggactccgcagagcttgttgctcagcttcgctcgagacatgctctttctcagcgcatccaggagggtgatgccaacgagaacgaaaagaccattgctcacaagaagggctacaagaactacggcctggacctgatgcgcgggaaggtggttgatgagctcaagattggtgttttggagcccagcatgagcaaggtacggcagctcaagagtgccgtcgaggcctgcatcagcatcatgcgtattgataccctcatcaagctggaccccgagcaacaagaggacgatggtcatggacattaaaagtggttatgataaaatagagaaggccttcaatgtagactttggagttctgaatgaatctacaaatcaataatttatccgtcaatcatgtatcttgcctgactgtagatagaacttggtgtctcaacacattaattgaagcttgtggggttcatattcaccaaaataaacctgttgtaaccaaattatttaggacgttgtatgatttatacaatgaataggccacaagcccacgtctaagaaacaagagttgtgcccacacaaatgttggcttgttttactgtcaccgacccaatctctctccttctccccactccggtctacaatatgtgtttatccgctagcccccattcaaagttattcgtacacccgcagcctatgcggctcccttaaccgataaccagcttgccctcctcggggaaatcgtagggagggacttcgaggttcagaggggcgggtccctttcttatacggccggagatgtcgtagtgagaaccgtggcaggggcagaaccagccgccgtagtcgccggcctcgccaatggggacacaaccaagatgggtgcagacacctagaatgaagggatatttcgtcagttcatcaatgattcatcgaccaaacggggcgacctcgcgcgagcacgactcgccaacaatcaaggacacggggaagctcatacccagcatgaccagccactcggggttcttgacacgctggtcgtcggtttcggggtctcggagcgaggcgacgttgaccttgttggcctcgttgatctcctcctgagtgcggtggcggatgaagatgggctttcctcgccacttgatgatgacctatttatcactccgtcagccccctcctgctatccaattgggctgccccccaaacgggcccatcgacgcctcccggagaaaactcacgttcttgccctcggggatgttgttcatgtcgacctcgaccttggccatggccaggacatcggcggaggcggacatgttgaccaggaattctgcaatcacggatcgtcagcaacggcccaatccctcaatcccgcgcccctctcgcggcgctcccgtcgctcaatggctcgccctttcacatgttggttggtggtggtggtataacataccctggacggtactcttggcgccggcggcggtgatggcgcccatggcgccgaccatgaagtaggagacgagcttgttggagtcaccggcgttcttggagacgtattttccaaagtcggggatcttgctgcccttggagcccccctgcttgaaggggctgctgtactgcgtgtaggaggcggccgagtcgccacgggtcgctgcggtcgtgctgagggcggcggcgcggacggccgtggccttgctggcccgcaggcacacgcgggttgcgttcgtcagaggcgccatcgtcggtggggagggtcgtgtgacggtgtggtcgggcttggagggcgaagggaggtttgaggtcttttcgtttttgggtgtgatgatgctttgccgaaagttttggactgggtgcggtgcctgaggctgcaacgggtgctagagctcctaattgggctgcgctgattggctgtgctcctgcggatgggtcccgatctgttccgtttgtcacgggtgggctgataggctggcacctacctcaggcctgggcctcgaaacagagcaccaaaactgcctgcggctcagcggagatcagtgagaaggctactgtttgtcaaactcgagattccctggtatgcttaaaattctcaattggcccatagtagactcctagagaatgtcagatgcagacgagcagtcaattgctccaattgggccctgtttccgccttgttccgtggaccaagcacactaacgtcagccacaagggtgacaaaaaacgcgggacaacatggtgggggaagccatggatgccttggtgtattgtagttttatgtcaccggcgtttctggactgaggccaatggctaacagcagtattattacaaagtccgaatcattgaagtcatctacatattcgtgcaactcatttaaaccgcccagatagatctatcgtacgagatgcgccttgcccttctttgtctattgatcaatgcagccttcgcaactcctcgacaatgttacgcatatcctcgacactgggtcccagaccctcgcatacctcttcctgcatgctttcgttcatatccaaaaatctttccaacatttccccatcgagaaaccggaagggcccattattttccctcgcctcagaacggtatgcgcgccataggtcaaaattaatgtcaccaacgggcttcgcatggcgggcaaggctgctttggaagttgatcaacaggtcctgataccttggagcaacctcaccatacatgtaaacggaaccttcagactgaacacaatgatgttagtgggacataagatgcgtagccgtcttccaaggtcactactcactgaagctaggaatgctttaggccacacagcagcattctcgtctggtgcaacatgaagcttcctgatccggttgatttgctctccgatattcaactcactgataatatccatcctttgccgatcttgctccaacggtgcttctttgttttgtctcaacaccacaagatttccttttgaatctgcctccaaccatttctcgtcatctaatgcgcaaatagccgttgaccacgacgggtggtagtgtcttgcccgctcgtcgagcctcgcggctgttacgccctggcgtggaacaaactcaaccagggccatggattggctcaggtctactataccaataatattacccgtaatgtcaaaggagacggggacactcgcgggccggtacgaggccaatttctcaacttgggccgtcgcagtggtgtcctcggagtaactaaaaaccaccacggtcttggtcagtcctgccacgatatgatcccccatgacacccaggcaacggcaattccctcgaagctttatttctttgatttggtaaagctgccggttttgatcgacaccaagaacgagaatacggccctggatatcacttcctgccgtcaaagatggcgaattttcaacgaagctcgtccctactattaatctctccgcagggtttccgttggaatcatggagtgacgcacgaaccatgcattcaacgagctcggttcctgtcgaaccatcgagtaagaatggtgtaccttgctcttggaaaataatctcatcaaccagcttgatcgtgttggtgattatctcttcgctttgaattaactccttcttgatgcatgcaatggcaaacgccttcgaatcaggagcatacgctattcgtcggacagtttctctaacacgcaagggcttgacatgggtcagacgttccctgtcaacaaaactaagcttcacatggtcatttgttgaaataatgatcgacccggggaacgcctctgagtcaaagggtgcgacgaaggtcgcgtcatcggcagtcgttgctgaataaatgattctgccctcagagctgtagatcaaactagcaaattccgttgtaacaaaaatgctacactctccatcgccgtgaggcaggagatgaaatcgcgatgggccgtttccgagcgtcactgtctttcgtccagatatttcaaagttgctgatagagacgttgaatgtgatcacattgccgtcttcagtagcgataaacagagtagggccggaagtctccacgggatggagctgaacaagtactatgtctctgggaaccgaggcgctatcatcggattgacgcagagactctccatgaatcggctgaagagtggcaaggtcaatgatagaaattgtaccagaagcccaccagccaacaactcccaggttctgagggctctgagcggcgtgtatgcacgatatttggttctcaagactattcgaccctgtatctcgagactgagaaagctcctccaggtcattctcgaggttgaaacgaacgagaacagaaccgtcgatggctagcaataaccacttgtcattcgctgacgcagcagtcaccactttaccctcagggcttgtccaacttgaagcagcaacgccgctctcaggatctatcaaggcaacagatcgcgttgttacttgcaaaacttgccccgtcggcaagtttcttagcagtagagtctctgattccattattattccttcgtggctgaatacctcctccacacctccgtccgcatcaaatttgaatacccgtgtcagatccatcagtgataccacgagcgtgtcaacggactttgctccatatgacttcagcgtgaacagagctcgggtatccgtttggtcaaaaaggataccccagtcctccaggccaacaccgcttcgaatactcctcagcgtgccgtcgtgataagctccacagcctgccacaattctagcctgcccagaagaaaaagcatttccagcctgctggtctccgtctctattaccaatatccataaccgcaaaatccagtattggtgcgttattggaaaaactcttaagcagtctcatttctttggagtgtgtgttcacgagtaaaagctgagggtctccatgatgggatgctaggaataagatatcttgaccaagatagaccagtctcgatgccctggccgtcgtcggaaaatccgtgtctgtgaatttcatcgggcatacattcaaccccgtcacaacttcgccagtaggttcgcttgccgtctcaaccgtgagaagatccatgcgcccgtaatcatctgccaagaaatagtgcgttgcgtcgtattgtgcccatgagatatagatccttggttccttcaagcccgaggaaagactggtataagtcaagctgtcgaaataagtcaatagcgtctcgccaataacaaggaagcctccgagatgggctttcgtcccttccgatttgcgaacatggtatcgtttctcctcggggacaggaacaggaataatcatcgatgcatacggatccttgattttctcgtcgagctccctgtctttctgggggtcgaacttggagacttctccacccctgtcatccttggtcaagcgatatactgcgatgcgcgcctcttcgtgctcttgttggctcttgtatagaaaaacgatccttggatggccggttcggctgtgtatgaaggcgctagccttcatccagagttcggtatgccttacttgagctatcgcatccaatcgagttgtctcccgccctctcgtgcgcagcttaaaaacggtcaggacgccctcccagagatgcataaccacaaacttgccggttggatcaaccaagcacttgttctggctttgcgaatggcgcatgaatggttcggcttcatcgtggatatacttttcggtcacagtttcgacctccttcgtttccgaattccatgccagagtgaaataatgctgcctatcggtgcctacgaaaagcaagtcggtctcggagtccttcggctggagtctctgaagcataacaatcgtgccgtaaatgacaacggagtgttttttggtcaagccatcttcgtctagctgccatatctcgatacgattcgcttttctgccagcattgggattagactcggtgccattcttggtgtgataggcataggtacgcggtggaagcatcgggaccacttacgagaggaccagatcttcctggtctggagagaggaatctcatccacagtgcatgccgaatgctcgtggccagatgtaccggcgcgatgtacgacatgattaaaccatcaggcgagaaggacggcacgatgcgtccagctgtggaagaaagttggtctgcttcccaagctttatagcggggagagctacacctcggacggggttcctcttgcggagataggcgcgattcaaatgcgtcaccaaatatcggagttagtggcgccttccagggccaccgcgacagactaccttggttaccctacaccgaccgaccacctatgtattgggaccaacacaatgtcaaaagctcatatacgtgaaatatcaagatatttatcatagatgaatttatcgatgctagactctgcaaaatactaagtcgtattttaccgcacatgttaaatacccgtgcaggtaggcactgctagttgtaccttctctcgcaactgccagttgacgacgccaggttgaaacaggaaagaaccctccagacaacaaccaactgcccttaccttccgcgaagaacttataaactagacagtcccgatgtagagagacttttacccattcagatccaatatatcccacctctggagttcgtcatctcgatctaactgatttttagatatactcaactctaatcgaccatggacacccccaagaatacacccttcaaaagaagacttggtgaaaatggttccacaggagaagaccaggatgaagagaatgaaactgctgcatcgtatgcgcggaaagaacaatgcacctgggatcatcgcaaagctccttaccgattcgagtcatgcgtcttcactcttgctccctcccacgagacccgagacgcgcaaggattaattgaccaaaatggattggcagccgcacgcctcccagatactcaggttgatcttgacatctctagccccgagaatatacacgagtctcactaggatttcgacgctcgtgtagattgctcgtcgcccccatcattcccttttcgaccggccaggtccctcctcaaagatcgtggatttcttctggagcttgttaatgttggatctgacccagtggaagacgtaaaggaatatttgaccttggttgaatctgcaaatttatgccgattggttgaccaatggcttccgttatgcccaaccgaaacaagacacgatgagggcttgtcgtttccagagagatccagttgggtccactcccttcttctacgagcactcgacaaggagcagatcgagctttcagaaatgtcactggaactggaggcagaagtagcgaatcccaaaaatggtccacctgggaaactaccagcaaggctggattttccatgtgcgaaatttagggcaaaagagttgctaccggttagcccacccttatctccagtttctgatgacgaggatgatgacgacgggaaagcctattttgtgccaagcgaaggagcatgtataattgacttaacgtcggagcctgatagtccggagaaggatatgactttcgagaaggtggtgcagcaaattccagaccctggaccgccaattccgatcagttatgagaatttccctggtccagaaacatctcccatcactttagcaatttcagcccatccgaaagaagaccctagactagatgttccacttgtatctagcgcttcgtcaaccgggacagatgagaatactctccagaacgatatccttgagctgaacacggactgtagcaaagaggacccaattgatgagccaaatggcgggttctttgacgacgcttttaacgcgacagttgaagcttgccattccagatcaatgctactggtccgccaggagtgttttaaccctcacgagtccctttctcgggtccaagtccctcgactggagctttatataccacccgaggaatacaccggtatttctgaaccgaaagatctatttcgcaggatgagcgccaagaataagcttgccttttccatccccaaggagcaatgcaattctaagctatcaaccatattgaaatgggacccgtttaaccattcaagaacaggccacttctctggaatagaggagctcaacccactcactgatagaagtgaagaacttctggccataccatcctcgcctcgaaagaaaattttcgatcatacagtcaaagagaggaaattagccatacttacttttgatgagaaagatttggaggacataagcgaaagcgagaaatctgattattcgagcgatcatgccacttcctccgaacggatattgggtcaaataccccaagaaccagatctcgatttccttgaacctgtcgggttctcgtctctagggcatttgccaggatcgaacatgaataagaaactggatctctttcttcctctagctagcgacggagcagccacgagcaagttacttgcaagcttcatggaactgagtggtgcgaagagttcatcaaaagtgtcccgctctgatgacgagcccagcgagcatcccaatacgagttcaaaagataagtatgggcgccaagcagctttctctaatatcagctcgaaatcaacgtcgcctttaataaatccccctaaactagttccagctgaggtaccagaatttactaaacctgaccgacatggtgtattcctggtttcacttaacattgaccatcgtgttctttgtcagctggagaaatattggcctcctagttgtttgatcgatggcgatatttcaaattgcaaaagctggtactcgtcggatgccgacgaaaccggccgagaaagctccaacttacccgaactatctgattgtgatataattctcacatccagtgcaggcataattatcacgagccttgtcaaggctaaacaaacacaactcccaggatcaacaaaacgacccgagttgcaggcacgaatcatatccgcaagtgagagatatgaaacgctattcgtcttagtctcggaagaaaatctgtctggggaagtcgtcggcaacccaaacccatctgatgtggctgcatatgcggaattcgtaaagtttactctcagtcttggcgcaaatgtgatatctcattacgttcccggcgcaaccgacacactcgccaagtggattgcatcattcatgtcccattacacgccatatgttctcgaaattaagcgtttcctaacatgccaagagaccacctgggggatgtttctccgacaagctgggatgaatgccatggcctctcaggtgctcgcaggcgtgttattcgaggagtctggaaagcgcggtttggcctcgttcctcgtgatgccggtccaagaacgcatttcaaagtacgcgaagatcttaggagggcagaaacaactcgcaggggtcagtcaaatcttggatgaagcttgggaatgagatatgtctgctttatgtaaatgtggtagcatcttgggagacgattgaagtatgctgctcgaaactgaagagggagcgagccccgaactgattatgccacgtacgtattacacaggccagttagtatgccagcatctgtgggggagggagatctacgcttgtgaagttggctggaggttgacatgtagaagaccatcttgagacatcgaacagagcgtgtttctatatcacacatgttctatgtgacccatggccgcaatctatagatgatcttcagacgtagcaatcaaccgtgaaatatagcatctattcggttggtcgccccaacacatgtatctcattcttgccatcagcacaattcccacatcggccggggaaagtgtttcaagtgcgatccgtgccggcgctgtccctctttgataccgacgtacaccacacggcgagagggatttgccaaagtgacggacttggattcaaggccgtaatagtcacaaatagcgtgggtgagccaccgcctaaagggaaatgcggttagttgagatcatcaaagacaggggggggatgctcacttatacgcagctccttcaccctcaccgaaggaatcgaaaaccatgcccgagtcgacggtctcatgcgacacctcccgatgcgccctcttccacccgccgccgccgcccttgccgttcagctccctcatggcgccgctccggcccacaaagacaatctcctcgtcgtccgagtccatctcgcccgccgcgctgtcgtcgagcaggtcctgctccctctcgtcggcgcgggcccgcaggtagccgcggaccggctcctccagggcgcggacccagctcctgaccacggggctcctcttggccgactcgcggaggtcgcggggcacctctcccgcccccagccccgtggcgctgccgctcttaagctgctgcttcttcctctgggcggccaggcgggccgtcttgtcctcgacgcgctggcggacgccgacgtcccagaactgggccagctggtaggggatgtggtggacggtgtgcgtggcgcggacctcccagtctcgaggctccgggggctgcgcgttggggacgtgcatcagacggtctgcagcagagagcagatgcctggttagccacctgtctcgttgcatgggagaggggaagaagtaagatccggaaccgggcaaagcaagaaggggagggaggggggttgtgcaattcgttatttaccattttcccatcggcggcgttggcggctgccctcatttcccttcagcacggcgtctctcttcttcatgctgtccctccgcgaggggggcctcctgggtacatctgtgcgtgttgcctcgggggtgaaccccacggatcgcttgggatgctcggagtcgatggcgatggcgagcggggtgccggtgccgcgggcgacgggggagacgctgagcgactggagggccgagatggtccacgcatcgatgtccacgcctgttgatggctggtttgcctgggacctgagggctgagagagggcttgccggtgcgggatcagcagccagctcggggggtggagggactgcgctgtacatcgccatgatcactttacgcggttggtcgtatcgataacgggcggagataagatatcggtaggtacctagttaggatgtaggtagggatgaagaagccaattatactgattagagtctgggagaggaatatacgtgtgctgcaaggtgtcaggtataaggaatggctgtaggtgtcgcaattgagcaaggagagaggctcggagagggttgagcttaagggcgtcggatgtggaggcggcgtgtcacacggggatcgtagtcgaagacgtcgagactgcctgcaggtcaggggcatgggtcgtgggccaatcagtgggcgagcgcaagccaggtggagggaagataaggcatctgggctccacggaaccgaagctccgatgtacagtacctttctgtctcggaactccaggtaggtcacaaagtcgctcgcaggcagccagctgttacgttagtaagacgtaggcgttccattaagttcctagtagtggcgtgctcatggctcatgatgtgcctttgtcagtacagtttgagcttcggtcagcagttgcatctccagcccatccgctcagtaaggatgaccatccggtacccacgatacgagcgggactttgcggctagcaatcatcgtctgagtcactatgaatcacagcagtaagagctgaatgtcgcaatactaatcacatctcagtgagtcagaacgccaggcagaaagcaaccaatgtatctgctttagtccctttgcccgcgtgcaccgtgcagtgtggatgttggtaaggtttccaggggaaaactctatgagctaatccgaccccctctgtctcggccgccaacttaatgcacgattcatacacatctgacagcgaattgaatgcgagtgatcatcagctctagtaggaaatatcgtatcaattgaactgggtcctatagcaatgagtcctttcaatgattcaatgattgactcccatgtttctccgtgatcaataagcttcaattagtatgtctgtgcgtacccaaaagtctgacatgaaaaaaacaaagtgctaactccgctaatggtgatttgagttgtaggtcttgtggggattcccgatccccccaggcttcaggagaggctggttctctcgggcgatggcccgctcctctcgttcctgaatatcgtccaagtcctcttcagtttccgcatacaattcggggtggcctgtaaatggccctgggagaccacgctcccacccttccgagtatgtccggtttgctactggtcgccggctggagtggtatcgatcgacaggagactcgggtgcactttcggtgtaattgtagacgggcctttcgcgtcgtgctgcgagttcgtatgaaatagccaagaatagaaccattccttgcatgccggctgtcaatagatagatggcccaggtactccaaccttcccagccgagtcttgcgaagaggcttgcagcgaagagtagaccaccgggagtctgaatgcacatcatgggaatgctcagacttccagcatgcttcagcttataagtcgtccaaatctgggggatgtactgaaccgccgccaatgcagctgccatgacgccaaggaaattcgcccagaagttgaggtgactggggagtgcaatgacaaagactccagtcaagataatcacaatcaacccgtggaagatgcatagcagaccgacagttgctgcagtacgccagcctggggcatcaccggccaattcttcctggggcacagaagctcctcggtatcgaaagaaaatgaggaatagaacgaggctgcatcgcgatgattagtaagggtagtgatacccgggcaaagacaatacagtaaatactcacatgaaaacaaagcagagccactgtgcaccaagctgtgcgacgcccaataaacctgcagcacactcaaaggtatccagttccttgcagcagccaatggcggcgcgagatggcgggactgtgagaatattggcgaatccagcagtcgcagacgtcgtaccaagcagaacaaagtacggggatattccctcggatgtaccccgtgaaatgatccggtagtgttgggggagatatgagacgaacagaccgaggagaatgacactgcatatggttgttaattgagaacgctccatagggctgcgacgtccactcacattgaaactgtcagctcgaggtacgaaggttcatggtatgccccgcactgggagctcggtgcatcaagggcttccatctcggctgttttcagaggagatgccttctttgagcgaagttcggatggtcgacagccaggccctgcctaacttctgtgattggccgcgttatgtctacggtgccgtgcaattcggtcgggggttcggtggaagggtgtggcgtacgtacgtgctgtcgggaattatcgagaactgagatccagatgatcttgatagattgagccgcagcgcaggacggactacggaaccatcttgtgccggatgaggcggtaggagacgagagggaggccaggcgggctgctggtcagacggggagtagggcggttcgttttggcagcccagacgattggctacgtgggagtgaacaggcagggaagcagcatgcgcaggaatgggcaagaacggtggtaatgagcagcagcctggatgtggaagggaaggtgaggtgagcaggtgcatggacggagagacaacctgaacccatccgtctgcctggggctgcagtgcacgggcggccagcgaccactaaatgcaccgacgccccagtgtagaggccctggcaacagcccatggccgcctcgccgagcggaagggcccactggaatggatgcaattagacttggggtcgtcatagtcccctggggacgttgaggtcacgcggtgcgttattttgcgtgcagaggtacatggcctgcccctcggcacctaacagtgacgtgtctagcctgcgcggttccttgtggtacagcgatgccagaccgagccagtgtgcgctgatgacgtcgtcccgacaaggtgggacctgcatctcgctcaaagcaaaacccctaaaagtgggattggaccatcttgcgttcgcaaactgggaccagcctggatggtaatttaccatattcttgggcacccagggtccattggcaagtgggaattcatccaaccataggctgctggagaccaaccacctacgattgatcacgcattgccatagacaaatataggtcccgttgtcggagtgctgtctcaggcaaaatccatcaacagctgatcacattgaggcgaagcaagtttcattcttccgaaacttctcgcagagcactcttggcaaacctgcggcttctttgcttgcttgcttgcttgggtggctcgtacctgagcagatcacccagccttccttgacagccgcacaccacacatattagaatacgagcatcatgcaaacgccaagctactagtttgttgcacccggagatgacaagcgtgttctcgtgttgcaatggacgatccccagtacggaagcagtgatagatcaacgtctacaccgagctcctccaaggctgagccaaaagcagggcctgaaatccgtctcgttgcagaaatccccaattcgaccatcaccaactatcaagacaccgaaagtcagaattcccatgatacgaaaagtggacccgactccttctttacggccgtccagtggacagcagatggttcgtctctagttgcaacgtcctctgacaaatcaattgcgacctttgtgataccggacgatctcctccagacgtcggatccacgcccgctggtcccccagtctcttaccaagcttcctgaacagccccgagttgttgcacctgctccctacttctcgctcgcggagccagcaacgcagaccttcttggtagcatgtcgtgagcatccgctgcagctataccacgcgttccccaccgagggctattccaggcctttgtgtggctataagcttatcaaacaggaaaccgaggcatacatcacaccgtcagctctagtttgggaccattctggcacgcactttgtgtgcggctctgccaaccggctagacctgtttgacgtgtctcggcaaggatctgacgggcccatcttgacggtgcctacgattccatcccgaagacatgtttccaaaggtggcggggttggtatgaaggggaccgtgtcctcgctcgctaccgcccctgctgacgccaatggctcctctataatagcagccggcacttggactcgctgggttggtctgtacgacctctaccgcgagaacaaaaccattgcgaattggagcatcgcgcacgctgctaacgaggtgtcggatgtagcaattggcgggcaaggaatcgcccagactctctggagcccttgcgggcggtacctggttatcaacgagcggaacgccaatgggctcttgctttacgacataagagtcacgggccaattgcttagcatcctgaagggtcgcggcgctggcacccagcagaggctccattgcgatgtatttcccagtgcggaaggaggtttcgaggtctggtccgggacacaggatgggactgtcgtcgtctgggatggagttggtcttcacagtgagtacgggatggagccttcctggcactggaaagcccaccagtcaccaataggaagcacagtagttcactcaagcggctcagttgctgctacatgctctggtggctgggaacatcccaaaacatttgaaagtgaggatgcagacgagaaacatgacgtgcccaggtcacagtgttccgtgctcgatgagtctaccctcaagatttggtcgatgacttctcccacccagactgaagagaacacaaacagtacatagcccaagtacacatttaccgcggttggtcgttggtttcttgaatcacatcacattttaagcgcggccttggcaccacctcatctcaccgcacagcccattgtttcggcttactgcccttgctgcgccaagttttcccgccaacttacgcgccaggagtgataagccaggctgcccttgtcggtgcccagccaatacctggctaacctgatgatgcacgcaaggggtgataattaagtgccgcgtttcagactgctgaagaggtccgtgtccctggttggcggaagtggagagtgccagcgaaccacacacgatcccagcaccttcatttagctgtatgtacaacatcaacggcggtcaataactcgatctgagccctattagcggggaggcttcaagatcaatttattttccggatggtgcgatgtcttggctgaagagaagcatcgtcgaaattggcctccttgggggaaaaaaattaagttaagagtcgaggatcacaggctcagtgtgtaagaatcatcacatggggctgtggctcaatgcagacacggagcggatcataacgcaacggcattccggtttcactcacgagaaggctatacccaacgtgaaagtacgaaatttttgctgctgcaatttcgaagctgcccatggtgataattttcctcatctatggacaagtatctgagaatcatcaagtcgtgttatgtacatcaaacaatgctcccctagccaactcccgtctttgtgtgtttcgcttaactatttccaaaacgccggcaatgccaaccaagcactgcgcgaacccccccaaaatcaaacaaagtcattattgatgcaaattcctgttctatccagtaacgagaaggccgggggaagacaaccaaagagaggaagaaagcgtctacccaaaaggtgggatgccggaatcgcgcggccagaaaaccggaaaaaataaattaagaaatggccagaaacgcgcctctcaggcatccacgcacagttggcgatggacaagagacttgccaggtatctaaatgcgccgtaaaaaggaataatgataacagagatgggggatggatgtctgtttcatatccacccgtcttttgtggtcctgcgattttgctgccaaaaggatccagaatcggtgccccgtcggcctcggtaggggttagtgtaggggtcgatggcactctcgtatgaatcgttcgcggggtcatggtcttgcggttcactcaaaggaccttccggttgaaccgaacggttttgcgccgcttgcaaggtgccttgcgggtcgtcatccagttcataaattgcgctcaaagccccgttgtagccgaaggcgttctccggttctctcaagggctgctggtccgtttccatgtcacgtcctcgaccaccagccattacttgctcatcaatcgtaattggcgaaacgtagtcatttggtgatacctctcgcacgggctccatgcctgggtgatgccggtttttctcataaacagcatcccctggtaatacagggttcatgtaggtttgggcgtaggagcggtccatctcatgcgttggatgcagaggcgtgaagacatttgtgttgtcagaatcatcggaactatctaaagttagcaaaagagggtctctcattacgcaaatacaagtccggggagaattgcccatacgttgagaacttgggctctctctgtggcccatcgtgcaagggttcctttctccttcgaataaggaaaatggcgagcagggctagaagagcgatcagggcaacaccgccaacagtaccgccaactatggcaccaatggggggcgaattattgctgtcctttggtgcttcgtcatttgcattgtccttgtcaccatctccaccattggcgccgcctgttgaagtagggtttgagtcagagctcgatccagtcgttccagtcgttccagtggaactcgtcttcgaagaagttgtcttcaaagaactcgtagtgctcgaatccgacttggacgaggacttggttccgagggttgtcggttccgagagagaagtggcagtcgcagtaaactcgagactaatgctcgtcagatccagcgtttgtttccccgacgcagacatggcgaccgtcgtcgccaggtcagatgccgacccgcacccatactggtggtagccgccatcaaactggttctgataacacacattcccacctccgcaggtataaacgtaagggttgatttccgtctggggatcgctgttgccgtcgacacatccagtataaacgccctgcgtacaagggccgccgtcgggacagcaaccaacaactccatgctcgacatcaatggcgcagtgcgaacctgcagagcaggtggccggtagatcagggttccctcctacatatccgcaaactgtgttgagttgtcgtccaagcaggtggttggcctcgggcatcaccgtcggaagaggccatggcaagacattgagctctcgaagctcgacggtatgtgtcttctgtggaatggcgtggctgctggcggctggaatgatgctccaaaggagagcaaggctcgaagcgcgcgccaatgatgacgtgaggccgcagttcaacatgccgacagatgcagtgtttcataggcgggcgaccaatgaaagcaaatccccaacatgcgctcgcagactagtgtgttcgatgttctcgagaacagctgtttggaaggtatcccaagcgcgacccggccgtaaacatgtatgtctcacatgtggaaaaaagagagggggagcactgtaagatgcaggccgggtgaggttgggaatggatattatgcgagtcttcctacctatgccaacagatagccaagagagcccaggctgacctgttgaccagcaacgttttggaagtggccagggcagcccagctagcaacccacactaccctcgttggaggggtgacttgcagggggtctgaagggggggcagggaggtaaatttagcagcctcctcccccgaagccatcactctccagcgcagccacgggtgcttattgggcagtcagacgctacctacctaagtgaggtaagcccgatacccgttaccgaccctcctagtgtcgcaaagcgcccttcgttaagtgcttgccacttaaatctcccccacgagagatcggtactaagcagtactggagacgataggtaatccctaaaacctgtaatcttccgtgctgcacggcatggcgagacaatcagggcggtcgcggcagtctggcagctgccgggtacgatcagtcagttccctatccaaccgagcggatctaaatcgatacgaataataagaagactcagctgctgtcataatgctacttcagattttgctataccgctcagccccaacctctaggatcctggggttgtaatataggtaggttctagacctggacactccagtgatcacccacgaagacagaagagtgggcactcactatagcccatcatcgatgccctcggatcgctccgtatatgcactctagctcctgagccaaaggcatgccgatgtctgcgccacagtcgccgttgcagaaccagcagcactggctcgcactgggagggctcgtgttttttttaggctctgctcatcatctaagctcgattgcgtcgattgaggagcggcagtcagagccgacctaactttcctacgattatgatacgtatctagtaatacaaccctaccttgactgatgatgcctgtcgctatgacatggtgtgcagagttgcaaggcatataaacaaggcaacatcaaggatctgcgccatccttcacgtcagtggtctgggcagatcaaccagagagaaggacgtaatgtaaaccatcgtaacaggtaaattcctacaattcctatctctgcatggtttgaaggagctgtgaaagccaggcaagtcacggcttagtcatgatgggggccgcaagagcctgacggaaaaactgtctcaaagttgtctgcctccagagcggtctaattacttaccaaatcatattaccactaaaatatctttgctagtgggtggacgaacggaatcagtgtgcgtggcatgtgacctggcaaatcccgctgtttccccggccagacccaggcacctcacagctacctaagacaaggacgcacactacgttcgtcattcggcatgcatgtgctctttcgccgccaaccttgaagacaggctaagtagcagctgattcatgatgccaccagaataacatgtccacgccgctcaggccacacccttctccagaggcagacagttctctctccgccggtcagaagcccaggatgcctgaccgcgatcaggttattgaaattaggggcaccagtcacaggtccgcgacgcctgacagctcgcagcggtatcgcttccgttcgtcctcaccttcgaggtgtgtgtcatacactagagaagatgaatttccactagagcggaaaagtggtcctttctcaggaccaaaaattcagaaattcaaaatccgtgtagaatcccacatggaagaaatggaaacagaggccaattcccattcaagtcgtcctcgtgagaggatttgctgcagtgcactggtttcgtggatacgctttcccttgccttcgccgtttccacattggagtagcaccagttgagatgtgtgacgtgcctgaagactgctaacagctccccatgtagtttgtgtgcccagctgttaacgcactcccccaacttgcggtggagccagcaccctgctagtccccggcaattgccccgcagaatgtccagtcagtcatccatccactgaccgaccggtcctcccgtccgcctccctccaggtcgagtcctatccaggtacttttccaacatcaccttattctatcgctgctcctttcttcttcatgcattcagtgcttgcacagaccagctcgaattgcccccaattgacctctgccgaccgctgcgactctgctacaaattgccttgccccctccagcgccattggtccttgcgcgttcgcttaatccgactttgcaccgtatcctgcgcccacagcctcggcattaattgtgtagctcccgcggggccccattcactcccagtcatagaacgcgagacttcataccacggcactgaggtcgtggccggcaatctgtttccaccgttttgagcgtctcaagccctccccgtcccccctcaatgacgagattatagcttttcggtttggttagtatcgggtatccctcgccgtcgccgaggaccagccatcatgtcgtggaaggcctccgagcgcttgatggacacgatcaggcactatgccaagttcccagccaccggtgtgagcctgcgccaaatggtgcagttcggagagaagccatccgtcggtaggccgagattgaaacccctctcgtccagatgatcgtgtggtctctaacgctacgagccaggtactctcttccgagcctctcagttccttgccgaggagttgcccatacgattggcgcaccgcgtccaagagctagacgacttgcccgatggactgaacgaaatgccgtctgtgaacaaggtgaaggactggtacgcgcagtcatttgaggtaggcagctttgttcgcttgagtcaaattgatgtcgcgactggtttgctaacatgctctgtccctcatgtcaggaaatcacacagctacctcggcccgatctttccaaagacgtacgctctcgcctcatgaagcctgggagggctcatggtcgatccatgttcaagctatccgaggccaccccgaacccttccatcattgagggcgacggctctggttggggcggcctccaggcgggtggtaatggcaatggcaagagcagatcctatgcccgacgctatttcgccatggtggatgacaacggtgactggccagcagagctccagctctacaaccagagatttgcacagaccttgcacaaaattaagagaagacacgatagcgtggtcacgaccatggcccaaggtatcctcgaatataaacgccgccgacaacgcatgcagatcgatgacaccatccagtcatttttggaccggttctacatgtctcgaatcggcattcgaatgctaataggccaacacattgcattgacggaccaaagccatcaccgcgaccctacatatgttggcgttatttgcacgaaaacgaacgtgcaggatcttgcccaggaagcaattgaaaatgccagattcgtttgtgaggaccactacggcctgtttgaagccccgcggatccagcttgtttgtaaccctgacctgaacttcatgtatgtccctggccatctatcacacatgctattcgaaaccctcaagaattcgcttcgcgctgtggttgagacgcacgggatggacaagcaggagttccccgtcaccaaggtcattgttgcagaaggcaaggaagatatcacgatcaaggtcacagacgaagggggcggtatcccccgcagcgccattccgctcgtttggacgtatatgtacacaaccgtggaccgaaccccgaatctagaccctgatttcgataagagcgacttcaaggctccaatggctggttttggttacggtctacctatttcgcgattgtacgccaggtattttggtggagatttaaaactaattagcatggaagggtaagatttcacaccccaggtcaaggctctatgacgtcctctcaagctaatgcaaaacttctctacagatatggaaccgatgtgtacttgcatctcaaccggttgtcgtcctcttcagaacctttacaatagcaattacacaccgccggggcatcatctatcccccttatcctacgcaagcgtctgaaggaccgggaagtgacggaacgaaggcaagtgggcgacgcccaggcggtggtaaatgctcctccccatcataacccggacgatcgggtcctgtaaaagtatacccaaggggtaatacctcgcaaaaatcgagaggatcaattgatcaaagtgtggcatggaaattgacgttggattcaagaggcggtgacgaggtattcttctgttctatttatttttttggatgctaacctgcatgctgctggggccaggattgaaactattgcattttggagaaccctaccaaagcgaaggcgaggtgcagaaccaacatcacatccaagcaatgtatactttttgccaacggcataatgaatgggaacatatcttccccaggcagtggtgtgctgcctgttggacggggaaacagtatcaatgtatcaaacatcatgaggatctagttgttctagggttgcttgcgtgcgccgtctgtcgttattatactctcaaaaagcgaaaacagagaacagaggacaagaatcaaagacaagaaagctggtgcacatgtcggatgtgaatgtgtgacacaacattacctagctgcgaatgctagcggccatccatttctctggacgaaccggagtgcacaagccctcccaacccagccacaaatgcaatggtttcacaaagacgggactgaaaacacacatcttacaggtcccctacctacgcaatctttcatctcttcaattgaattgtacaaacctatgtgcttacctagcggagaagtcggcaaaggtgcgtcaaggtacgctcagtgcagccatgtttgcctctcggccgctcttgctcgttcttgcgagattgaacaaactgtgcgttcccgcgagtgtgagctggcggtcaactggctgcagcctccaatgcaccttcccgctttcacgttgattcctgactgcctggcgccgctcgcaccttgcatcccaggcacctaacctgaaaggtcaaatcgctccctctgtgattcagtgacaaaaggcatcccgttctcacttttccctctcttttcgtccacttccttgcaagcttcaatccgcctacttcatccatccaggttcctatcttgtgacagctcagctcccatctctactacgttcatctaccagcccattctttacctcgcggccttcctctctttcttgtaggcaactcctcaacttcacgtcgccaagtttctcggccccgcaaccgtcacgatggcatcgatggagatgaaatgctccgtctgttgcctgacgcaaccgatcacttcgttcagcaaggcagctagaaagcgggaggaaccagtaagaggaaccccatgcaccctatacattgtgatttctgctaacaatttatgttagatctgcaagaggtgcactcactggggcatgggagttgagcctgaagtgacaccagccgctcttcagactgggcacatctccggggaggaagtccgaggcgaggtctgggtggaggaatatctcaataccagaaacgagtcccaggacgcttcccaacatgcaacccaggtcgcttctcgagatgctgccgaaaccgagagccaggttgagagctcagcggcaagcacctgcggaggtgttagacttgacgtggatggaacgacgacggaggataccaggagcgaagtctcagagctcccgtcggagcttgcgtcctcggtgagagggttgacgatccaggggtctcgtggtctcccgacccatctgcgtcgcgggggaagcacgattgcctcaacttccggtgccaaaagcaccttctcaaagttaaggccgagagaggagtctatccaagaacaaatccttcgaaaggcgggccgaccatcatcatccgcatccgtggcaagtgggagcaatgtcagtagcatatctacggctactacgatgcgtgaggcccgaaacaggaccatgatcactttcaaccggtgggacaacactggcaacatacaccaaggtgtgaaggatgagacgactgcttcgagtgtcagctcggctacgacaacgccattgtcgcgacacgcttggccaaaacttgaagtcgctccaaaagacaccgctcctctcagggccattcccgtcgttcgcgagaaacgggcagagcgagagttcaactcacagaaggccaccacattctgcgctatacctcagtctgttcttgacgactccgattgagtgccagcagagcttcttcgtgcggcggccttgatttacggtggttttgaattaatggaaggtagcggctaggctagacggcaagaacacataatcttgatgttcagtaatgcactgatggacatgggggtctaggtttggggttacaaaatgtgcggatacgagttcgattgtgatagtacctttctagcacaaagtcgtcttagttgatttcaggagataaagttgacagtcaaatgaacaagagttcttctaggtcaataggcacttgtgatctagagtctacgcagagaaaggttgcctatcacgactggaactggaaggaggactattcttgatcacagaatggaggatctagatgtagggtaggtgttgaattgggaggatgacggcacggcgcgtcgcggcactatcgccgcgtgcctctaaatctggtcgtgacttgatcatctataattaaaattgttctgaggacatacctgatcaggcaagtcgcttgccaatccggttacttttggatgttgtgacgaatgaataagcaactgccgctcgggctggtacagaatggaagcgggatacccgtctgactctgtcgggtgtgtcggatgatttttctttcgctctggtgggtggcaagctgacatgactagagcgatactatgggccagcaagcacatttccgtcgttttgtgtgtgcattgccagcggttcacaattgaagcttggcttttttggtgacgacaggcgtccttccattgcccctcccgctcaattgggtgcctcccatacattttgggtacgggcactaaccgcagacaggactacgggcagcgatgatgattttcggtttctatttggcatcttctcccctcggcgcacgttggtcattggttctcagggaggaccctttcaatcagttcccctcgtcgggaaatggggcaaatgacacaatttccattgcttggagaggcaggcaggtaccgaaggcaggtaattactggtaataatggaacggcgcgaacctttgggaacaagcagcaagcattagtcgcgctttccgttccccacgagttggcgcgttgacaggcgctccatgctcaagcaagtaccggctacctggagccttgtagctcgtccgggcacaagagatgagaggggtacctgctgtgggtgggaggtacgtacccggccgccacttccactcgctcccaggtacccaaccacctggctcatttcctgcgaatggcaattgggtggcagggcaccaattcaccttgcatgacaggcctgttcctccttttcgttttaacagggcagccgaggtcggggaacatgcctgggcgggtttggctgctgcgcacgcatgtccagatcaggttgtgccctgctgcgttggacacgtccaggtttcctcattgaacggtttatagagcaacggtcacccgatcggctaagctgcaaatattggcactcctcatacccagcaagtctcaccagagagtgttttctttttcgccctcaattttcctcttgctagactccaccgtgtgctgggaaccctgcctgccttggcggcgcaatttgcgaccacggcccgctaagaagcaacgaaattgcgacccctatcgatggtacctgctgaagggtacaaggtacctggatacaaatcccgcctccttggtcctgagagtttcggtttgggggcttcatttccatgcaactcgaccctatccatggcataatatcccaaggggggcagacatggtttcgcatgggtccttcattaccggataatctaatcttcacaacgcacgtgcctgccagaagtacattcattcttgacagtgatcaatgctgaagggagactgtgtgtcggaccctgccgctgccagtgctctttgtgtggtgggtgcatttttagcaggtttcctctagggacgagccaccacccaagcgtctctactgggtcaattgtgacactgccctgtaataccggtgagtgcctggccatgttctacttttcttcttcccgtcttctttccttccgccctgttgaattttttttcttctctcgtcgcgcgcattcactctctcttccctcctctgcctcccgcttccgaaggggctggatccgaagtcagttcgcccagaaaatctcaagcggcctgggcctgtcttgtatcagctcctcgcgttgcttctttggcccattcccctgtgtcccccccggttcatcgcattcccctgctgaacagtcacggtggggtgatcgctggtcccctgtcgcagtacgcaccctgcttctctaagcactgtaggtagtagctctcgccccagaggatcattgcgctgggtgctgcactagcctgtagcccgcggatccgtttgggcgctggctcgtcctagtgacccgtcccccagctgtaggctgctcgttcccgtctccttttcctaccctgaccttactgtaccttaaactgagcttgctccttgcctctcactccagtctctcattatttacttttctccagatcaatcgaacgccatctagatataattttcgacgcggaagaagcatacacgcacgacttatctacgtctcttggaccgaccttgcataatctacctgcatacagctcgctctctatatacacccaccaatctgaatgctccggtcataggtacgaagctctgcgatagagcttgtcgagacgactggcgactgacccagcgttgctggatacgggcctgcggcggattgaatcaagtcgacgtcgagtcagggtcgctattccgttcggtttacgacatatctgcaatcatttagaaacgaacatctcaactacacagctatgacggtatcaagcgacttttcccgccgtgtgtcgtcacacgcgggcaacctagctctggaggataggttcgaagtgctcaaggagatcggcgatggaagctttggaagtgtcgttcttgctagagtacggacggcaggcgcaaatgttgctcgtcgcggcacggtggtgagtttcgtccagctctccagaggcagacgccagcctgggaccgcgctcgctgatactaatttgaaatcaatttaggttgccatcaaatccatgaagaagactttcgaatcatttcagtcatgtctcgagcttcgcgaagtcgtcttccttcggaccttgcctgcgcatcctcaccttgtcccagccctggacatctttttggacccatacacaaagaagcttcacatcgctatggaatacatggagggaaacttgtatcagcttatgaagtcgcgcgaccacaaatgcctcgacaactccagtgttaaaagtatcctctttcagatcatgcagggcctagagcatatccattcgcatcatttcttccaccgcgacattaagccagaaaacatcctcgtttcaacatcatcacacaacgaaccatcgaccgctttccgacgctactcatcacttgtcactcctccatcaacaccgcctacttacaccgtgaagctcgctgatttcggcttggcgagagagacacactccaagctgccctataccacttacgtgtcgacgagatggtaccgagctccggaagtccttttgcgtgctggagagtattctgctccagttgatatctgggccgtaggagccatggcggtcgaggtcgctaccctcaagccgctgttccctggtggaaacgaaatggaccaagtctggagggtctgtgagatcatgggaagccccggaaattggtatagcaaatctggatcacgagttggcggaggtgactggcgcgagggcacaaggttggctgggaagctgggcttctcattccccaagatggcacctcacgccatggagacgatcctccaagctcctcagtggccacctgccctcagccacttcgtgacatggtgcctaatgtgggaccccaagaaccgaccgacatcaacacaagccatcgcccatgaatactttgctgatgctgttgatcccctccgacctaagtcgtctacctcgactaagatccttggtcgcaaacaatccgaccttgctcgaacgacaacccctaccccttccatctcatccaaaccctcatggttccgcaaatctcttattgggcgtagcgaaacacctgagccactggcgagtcactctattcagtcgaacgacatgcccaacgcacgacctgtacctatccagctttccactcacagcgaagtgccttctgctgttcatcgcacgggagccggcaagcgcagcacctggaccaatgggactacttctaacaacatggcccctatgccaattctgccttctattcgaccaatctctccactgtccgatgcagtcaatgcacgggcaagcaagcatgtcgatgggaaatccaagattggccgccaaatgtctgtggcttccgctacaaatcactacacggagatgcaccgccaggaggccgagcgcgctttgaatggaaagaccggtcttgtctcgcctccaagcggccagaaggagggcttcttctctcatcttcgcaagcgagcaaggcgcttgtctggacgacatcagacgcctgcttcccccacatatgaggatgcagaggctgtcgctggatgtgttccctggacaggtagcaacaggtcctcgatgatcgtggatcaacaggcgatggtggccaagtcagacatgtacgattctctggatagaactctacgcgacgttcagaatcctgaacccaaggcaccagctcctcctgcacatcaagcaggcacgagcagcagtctcaagcgccatcactcattgcctcagcagcaccaccgatctgtcgataacctgatcggtgtggcccgcggcgggccaatctcgagccgaactcgacgagcccaggctgcgcagggaatgaaccaatatgagaccccggcagaggaagacgagcttcttgatgaagttcttacctcaacacacaaggcgatgaagcgaatggacagggatagcaagacccttcggcaatctgccagcaacctgggattggcaaacccttacccaacgccatccccttctgccaatggcaaccaggttctctttggagacggaaacgaagcgttgagaccaaagcctcttgatctcaacaagaggcagcaggggcattccaagtggcctacccctccgtatgaagagtccgagtgggcagcatcagcctcagccagcatctgggctgctggaaacaagatctagtgtaaatcactgctctgggagcaaaacatttcatgggaaagataacgtgcatctggctgggcacaaaagtgaatttggtgtactattttgcatggttatggtgttttggtgtggccaggcccaacgacgctcgttcagtctttcgttttgttaatcggatttggtttgttgctttctttttggcatcttgttttacattttacgccctcatcatcactccgcattctgacaccctcactactctggcctattggtgccactacaattattgataatacccggctcagtccttttccggattggcaaagccttgtttcagcgttcgctttgggaactttatatatacattcttcacaatctcttttccacactttttgagcatcaaatacccccgaattagactgagtggccaccgcagccgacccagcgataccatttggcgcagataccagcggttgcgaatatcaggaaatcatatatatatatccatccatctacatattaatattttcttcactctgcagcaagacttgctatccttttcctttgtcataaccgtttctatatccatttcctcttttccaagttccctttcgaattagtttagattacgagcaaagagagctggagtgcgagcacattatctctctgccaaaggacgtattgacattaagatggactgttaacacgttatttatttcctaaacgcacatacgacacgactcagacagaatgttctcggaaacaaaaggggtgtttgaggaggaaagtctgccgttgggcgaccatctacattaatacaaacatacattgacgcgcataaacctttgattttcctttctttcaatgcttggtgaacaaggtctagctcgacttatagattcatgcacggcgttgcgtaagtgatgcgttgtgcatgctgggacctgcaggtggtggcgagtgagggatgtgggctgcggcgccagagctgatttgtcaactgctctcagtctggtccgatcttttgttgagacttggtctgtgtgacggacatgttgttggtgagcactgacccggccgtatgcgtagcatgatggacatgaggcatgagaactggaatggagcagcagggcatgaagggaccgggtgagacctatcctggcttgggcggcacgagtaatggcggccctggcgtcgttctactttgcctccgcgatcttgcacaggatgtaggtacgaagctagcgatgccctgatctgatggcagccggttggtggtggggtaatgggtgggacagttctcattcatggacgccgtgtcagttgtcagtgccctgtacatggcgtggaggaggggaggatgagacaatcagggagggggtgatgatggcgcttgctaacccccccccttgaactctggtttgtttgggtaggtatgtgttttccattgttcgagcattgacggcccagccgtggcacatgaaatggtatggggataatacccgacgccgcaaggcccaaaggtttaaagggtttattccgacttgcctcctctggcgtcttattgatcggggctcccgagccgcgaaacatgcgaaacagactagcaggacgcggcagagctgccggctggctgagggtggaaaagcatagatactgacgctgacaatgggcatgcaacatgcgcgagaaaatcaaaaacgtgtgacccctgtgggcttctctgggtcttattcccgttatgcgccaatctcggggatgcaaggtgaggggccatgaatagaagcgccctgggaactttggcagcttggttcctttcctgctacgatgtaacgctgattgattgttctggaatcccacaacctgccgggggggggggagggggtaagccttgtttattttactgtttgtttcagggccggaacgagagcgcatacgagagctttgatggtaccaccggaacggcagtgcgtttgcgtggggactgaacgatacctttcacctgaagccaccaggctgagcacaataggtggagaagctgcctctgaggaggggcgggaccagtcagtggtagtgcgtgtttgttagcacgatgggcgcgactcaggagtctcagcgcggagtatcttgagatcgggggacttcctgggctgctgcgcgcggtggcaattggacaggaatcgtcgggaccaagatcgacggcgtttcaattgttcgcactggcgactttcatgctatggctggagaaaggcgatagcacgcgggctgatatagtggcgacgacgcgccgaacgtgatcggccgcgcatgatgggtgcgatttggcgggcgcgcgcaaaggggaaaacgctcgtgcatgggcgtaccggtacatgagaagcaggtactgcgacttactttcttgctttttggactgtctctcgtgtcctgggcggtggctgccggatggtgtgttgatacgacctgcctgtggtaggtagcactgtagagctatttagaagattcctgagcttcttggcctaggcagcctcgattattctacctactccaacggcttgcctctccttatcaactgtatttgatcgccttcctacctacctgtgtcgctagaatgccaggtgtaagtatctataggtagtccttctaagccaaggaaatgctaatagatctagacatacagcgaactgacatttgttgattttgaatatttcccccccggtagactatgatcggttgatgtcatgggcttgcgggggggatgaaggcgagggcttgattatcatcaacaaaaccgagtaaaaattacctcccgcatctcaaggggtacttgtgatgaagtccaaatttaagatcgttcgcgctgatggtggttggttggagattgtttctgggaagtctcatcccgacgtctgatggtggtttgatcaatacctcccgtcctgtccgagatatatctccatgtaggtagttcattgtgattaggactgaggatgggatgtgtattggccgtcgtatttttggaaagctcaatctaggtattctactgtctagcagaccattgcgtcattcaccatactgcgatttgggagcgcgtcagcttcctggacttggtgctgaggaggcagggctgagttgaggccaatagtccgtcttcgtatctgccacatgtaagcgtaagctaataaggcgaattcaagtgccatcaattggcttggcctaactgaagccggcgagtaattgccatgtctagtcatgctttcccgagagttgatggcaccttgcttgattctcccgttacgataagtctttgggaatgagcagctctttagttgttgcctggcgggataaacggccgtagcgcaggcagacacctaccggaaatcccacaatccactttgatcaacgtaagtagtccctttgctgctctggagaccaaccccttgcgatttaggtagccttccatacctgctatgtttgtctctgtcctcgaccagaatcgaagctaaggcctgtggccgtggcctagcgctcgtggggcgaagctacagtcgctgtaggcagaatcgcacaaggtcaccagaatgctgacaaccagcccaccaggcggacgtaggtcctgtaggccgataccgttttattactggcagtttctgccccatggccgcaaaccgtattggattcttacggctgattctggtggcaccacaacctcgacctcgctcacttgcctgcgccactgcgatacatcaaacggccagggtgttcagtatctcgtcgccttggacttcgttttcgagagcgtctgcctggaactgtgtcctgctgcattcggccccgatcaacgtttactctctgggtgccaagactgctgaccgtgactgcctacctgcggccagaaatcgatcgcactgattcatctgcctttctgatcctccgcggtggtccaggcggcctcatctgcatcgctggcatcgggcccggcgcagctccccaggccgccgtgtcagatctcgagacagaagcctcctctatcataaatatccgcttgtgggttccctcgatgtctggctgaagagttcgtggttgacttcatgtcttctcactggttccccaccatacaaaactgaaccgcttcctccattccccgcaagccccatcaatccgccccgactcatatcactctcctcgcagagcctcaacggcgcaccacgcgcaactgcaacactgccgaataaccccagcaccagctcatccccctctcccggaaccccaccatgagcttgaatttaccgctgcggccggccacgaacagcacctcttccacatccattaatacccccagccgccggaaccaggacagccggaactatttcactagttataccccgccgagctcgaccgaggccatcaatggcccggtgcgggagccggcgagggatcctgctcccatcagtgaccgtctcatcgtaggagttgactttggcacaaccttctcagggtgagttcatgtgtccttgccccagtttccaatgacgttacgttttctcgccgctatcttcaatcacgtggggcgatactgccaggctgtttgacagagactaaacggacctttagggttgctgctgtgtacacatcaactccagatgacatagagatcatcaaaacatggcctggaggcaatggaatcacctctgacaaggtgccaactgaaatcgcttatgatttccccgccaacttaccagctggcgctgatccgacggtgaaatgggggttccaattcaaacctgaggaatctcggctccggtgtataaagctctttctggataggacccagaaactgccgttctatgtgagccctttggacactgccgcgcaactcaaacgcttcaacaagaatgtggttgatgccgtgagcgactacttgacccagatttttgaccatacgatgaatacgctcaccagacgctatggcgaatccttcatggcctctacacgagtcgaatttgtccttacctgtcctgctgtctggagtgatgccgccaaaaacacaaccctgcaggccgccgagcgtgcgggcatgggtagcaagtcggaaatccagatgatcagtgagcccgaggccgcggccgtgtatacactcaaggctattcagccgaaccatctgaacgttggagataatttcattgtctgtgatgcaggaggtggcactgttgagtgagtatcccttccgtggcgtgatattcaccaaatgcttgatcgactctcctgtgaactaatatgtgacatgccagtttgattgcatataaaataatttccttgaagcccctgcgtgtggaagaatctgctgtcggaactggaggcctatgtggcagtgcctttttgaactatcgatttgaagaacatgtaaggaatcgcttgggccaaacacggttcgacgagatgaagcagaagaaaggcaaaacgtggcaaatgggccttcgatactttgaggaattcgtcaagcggaatttcaatgaggatgagcatcaagaaatcaatatcccgtaagtggacagccgaatgccccaagctagtgcaccagaggaagggaatatattaacctagtcaggttccctggacttcccgacgacgaggaaatcggcctggattcgggattcttggtcatgacagctgtccaggtcaaggaaatctttgagcccgtcgtcaagcaggtgaccgatcttgttcaagggcaggtgactggtctacgtaaaaaggggggcgttgtatcgggaatcgtgcttgttggtggttttggtcaaagcgactatctctaccggaggctcaagagccacttcacaagcgcagcaccgccaccttacagcgaacgcccgactcattccaacgccaagtccatcgaagagaatgcgtcgatcgaggtcatgcagcctgtttacgcctggacggccgtggtgagaggagctgtccttcgaggcctggagggtaacatggtcatctctcgcaagtcacgaatgcactatggaacgtcatacgctaccgtgtacgatgaggacaagcattctgtgagcgagagatattggtcgccactttgggaacgatggatggtatccgaccgaatgcagtggcatatcgcaaaggtaggcggactcttcttttgacgtaccattgaaacaattgcgcacaagagttgagatgctaacatgattgggtagggtgaaccactgtcgcccttatctcccatcgcattccattatacccgcaacttccgacccggccaatccctgattgtgacggacgatctcattgcttgtgacgcggatgagcccccggttgcatacactcgcgacctcatccacgtctgcacactaacgacggatctaaatgctgtccctcggagcttgtttacaagactcacaaccaccaggggtgtcgagttcgacaatctcgactttacgctagagatgattgttgatagcgctggcctaggttttgagctgaaggttgatggtgttagatacgggcgagtggaggccgagttccattagaagttaatcaagacactcttagaaatcacgcatgggaatgattgtctattcgtgaatagatggggaaaggatcagttgcatggcttatctacgctcagcctacttgctgatgatgccatctacctgatgtacactgtggcagtagttgggtaacacggcagcttgagggatatacttgttagagttggccagctcgatggacagggtagtggactaatgaaaaaagagaaagccaagttaatttgctggctgctacacactgattgctgctggtttcgacacgaatcggagcgagcacggccaatcccacaaattctgatccccactgtgcctggccatagcgagtagaaaccggaaccctatgacgacgaccaggtccatggcgggggaggggcagattttcagttctctttctgctgcggttgcgaattcttatcgcggcaaaaaaatatgggagagaatctcggtgagcagcgtgcatacataagcaagtggtagcagccagccttattttctcttttccttttacacctctccatgtgaatggatgtgtcgctaattttcccttccttggttgttttccccccaacgccgtgtcttatcgattagatcccgacactcatttggagccagttgagtgagccgtggaaccttctacttggagagcgaatgtgcagatcttgctgagaaccgcatccccaatggctgccgaccctcgaatcaccactctggtccaatgggcttcgagccacggggccgtcctgaacaaccatctcgaggtccatgacgaccccgtcacaggcttctcgttccgtgtcaaggacgggcatgtcctccccgcctgggagacggtcgtgagcctgccgacgcccctctcgctgtcgtacctcaatgccgtctcgcagggctgcttccacccggagctcgtctccaggacgccgccgcacgtcgtgggccgcttgtttcttgtcagggagtacctccgcggcagggactcgttctggtggccgtacatccaggccctgccgcagccgggcgccgacagggcgagctgggcgctggcgcccttctggcctgaggacgaggcggaattgctagaaggaacgaacgtcgaggttggattggagaagatccggcgcgacgtgaagagggagtacgaggacgtcacggccctgctgaaactgcaccacgccgagaaggaaggggcctttgtccgcgctgtaactgtgcagctgtaccagtgggcgtactgcatcttctcgagccggagcttcaggcccagcctcgtgctctcgccggcgttcgcggccgagaccctccccgcgggtgtcgggatggacgacttctccgtcctgctgccgctcttcgacatcgggaaccacgacatgacggtcgaggcgcgctgggagctcacacagggcggcggcaaggacgcctgcgagctgagggtgggcaggagccacggggcgggcgagcaggtgttcaacaactacagcatgaagacgaacgcggagttgctgctggggtacgggttcatggtccccgcgacggagggcttgcacaacgactacacgcacgtgcggaagaggactgcggcggcggcgcccgcgacatcgggggttgcggcggatccgggggaatactatatctcccggcggcccatggacgacccgagctcgctgctggggcggaacaggcaggccctcgtggtcgagttgccggcggagaggcctatgctgggggctttccggcatgtgcagccggacatggtgtgggatatcttttgcacgctggcggagagccaggggacgtctgccgcggagctgatctcgacgggtgtggaaggggagggggaggagcagcagcagcgggagaggcagcgcaagttattcagcggcgcggtggatgggcattgtgagccgttcctggagcagacggtggccatcatacagcacaagatgctgcaggagctggaacgcctcgaagagaccgaggtggagatcgtaggaggggacgaggacgaactgagtgggaaccagaagctggcactggagtatcgaaggcggtgccgtgccgttctggagaacgccctggaggctatggagactgatatagagtaaaggggtggacgtttgtgtagacacgagatagattacactgggcacaagggatacatgggcgcaacagacaggattgggagaggatataaacatggtttttgtcctcctttattagggttttttgggaggctgatttttgcacgtgttagagcaaagattatactagggtgcgatttccaagttctcatagacacaacgctccagctcatcgtagagtttcccgacaacggagtcgccaaacggctggacgtttgtgaacaagacggctcctatcccgctctttctgtcgatccactgtggtgaaaagtcgttagttagtttcctaaaaaaccacagagagacgagatccgatgctggcttcagggggaaaggggaacaagttttctcttacccatcgagaattacagaacccgctccaagtcatactccccttggcacgcttcccagggatatcttcgagattcacgagccctgcgaggccgtggtcgatctccagaccccttgggaactcgggggcgaagccctcgtgggaccccggctcgtacacgaccttccgcagcatggcgcgctgcacgtcatcaagctgggggcggaacatctcatccatggtctcctgcttgagcagctcacccccgaggaacgcctttatgaaggtgctgtagtcacgcgcggtggagaatagtcccgcgccgccgctctcgagggggtggtcgctgtccttgtcgacgggaggggccacggcctcgagggagccgtccccgcggcggctggtgtaggcgacgaacctggcgtcgaagtcgctgccgggccagaaggtggtgtcctccatgccgaggggcaggaggatgttggccttcatgtactggccgagggtctggcccgtggcggcctcgaggaggagggcggcccagtcgatggcggtgccgtaccaccagccctcgccgggggtgaacttgaaggggacggtgaacccttccttggaccagtcgaggttcctggcggtgcggccgacgtagttggaccacttgattaggtccgggttggggatgtcgtagcctaggcctacgacgtgggtgaggagcatgctatttatcagaagggtgagtatagaacttttgggaacaagtcttgctgtttcgggggttgggtttgggacagttatgggacagtaccgaagtgtgatgggcttagtgttgtcctcgaggatgggcttgtcaccatcaaagcctcggaggatctgcatagtgcccagctcggggatggtggtgcggacgtcatcgtcaagagggagggtcccgcgctcgacgagctgcatgatacatgttattgtgatgagcttggttagagaggcgatgtagttgaaggatctactgtcgaatgggcggccagagccggtgaggtcgatctggccagctgaggactcgataattgggccttgtgagatgaaatgagtctcgggtgaactggtatagatggatcaaaggtctaacagaatggatcgtaccagacttacggtcctttgtgacgactgcaaacgacgctccgatgagcttctggttggtgtccagatctttgccggttacgtatttttcgaggatggcatggagtttggcgtccatggtctcaaggttagactccatgattcgtataagattgttggggcagttttcaagaggctatgaggattgtgatggcaatttttcgtaaagtgacagcctcgcagcgctttatatgtaaccaaacaccctcgctcgaatctccgtaagattggttgtggataatggaattgtggttgcctggctgctaaccgtaccctgattgttcacaaccctgtaaggacacgttgtagaaggtttgatgaaaagatggacagatctctataaaattaatttgaagtggaagtggagagagaaagaggaagcgacgttgaagattgatcgacacttggagatgtggtaggtgggtgacaaaatgtggcacgtaaagggcatcttctaatgtctttcaccaaaactacgataagttttccactgaccaagacaacaaacacaaaataacaattgatttctcccaattgctatgctactattgtcaaccaaagaggattacgtgcacaacttactgtcagaggctggggtcgctttcgatgtgccacgttttatgtcaacatgagccatgatgactcatcagaatccattcgagaaaacatgtgatattctgtatcgtggtttggctcaggatggcgcacaataggaacgtcactagagatggcaaccggaatctttgactgaggttctggaaatatacaccagggaagggaactggcttagatctcgggactgttgcgggatgcaaaggccctacatgcctatttgggtggatggtgttggccttcactcaagataaaagccgatacgtgtctaagacttgacagatactaatagatacttcagtgttccttaacctagatagcagcccgactccagcatacgtatgtttgcctcactgtggctgggcgtcaggtgcgaatgcagagcgcgatggtagtggtgaggatccaagatggtctgattgagcacagccgtgccgacagaatcaggagcagcacgtcagatgtgcacaacggggaggtgcccgatatatatggcaggccagaatacctaaccgggactttctcacctaagatgtcattttggccagccttcttatcatgccttgccatgggatgcatgaaggagcaggttgaggcctgtatcggagagtccaagaaaagaaacgcctcacgagagtagatgatagataggtatataacgccgataccatgccgaagcgcggtcagcccaccatctcatggaatgcaagtgcaggattgaggcccgagacacctcgatttgttgccgtctcccgggcgtagatcaagtgagagagccatcccccacgggctgggcagctgacggtcacaagccgcggagggagggcgtggggggatcattccacgtccatctccccgaccgctgtgagcagaggacggcgcccccttttgcaggcagttcagtccacgtcgatcacatggcagagacggacggctgcgatgtgagccctcgtgttacgagagaggagaatagggaccaggaggctggggaataaggtaatgagctaagatgtcggtatcaaagagtacgaggctgccctctgcggagtacgtaagactagtggatggggattcattgttcagaacatggagcccatcacgcctgattctttcaggctaagcttctggcacccccgtagggatttattttggcccctgctggtcccctgctctgttagcggtccggccattttgaaactatcactacaaaataatatcccccactctcttcctttgcttgtagtcattcatacagacgctcgactacacgtggcggtggccgtcgttcttggctggattgcattgttatttgatagttcgtaaactaacccggtccttgttgccaggaacaatggtgatgttaactccatctcggactggagattgagtgtttcattgtgtcctcaagaccctaccaacgggcactgaaggccatccctctcctcctctcgccattcaacacgcggtgtacgtccatacctatgcatagatactgacacataataatcagtatatctctccccttataaccccatcctatgcacatcctcccgtacctattagcatgcccccgagtagattggctaagcaaggcgccgatccggggttcgagcatgggccaggcaggcaaagcttgtcaaatgcacccacaccgtcaagctcgctacatgtaccagcggatctcggtatgtaggcccaggaggagggggaggtcagcctgcattccaggatcggatcaggataccctcttacggatagtccttggtgggatgcagccaccaacaaatgttccttgtcagaagaggagaaggagcatgcgagcgtgccagagcgggcctctcgccatgtctgtcttgtcctacgggcactggcgaagctggcacactgtcaaggcgagctaatgtacgcatgttggagcagcagagcgtccttgtctccatctcaatctccacctcggtttggtggggtttgagcttgcgtggtgttggcagcagctctagtcagtgtcaacaggcaggccagcggcatgcgattcatggcctatctgtaatcatacaggtctctctgacttgaccagacccaatcagtggtaggcagaacagttctcaaacacacagtttcagtgcaatcttgattcctgcagcatgtaggcacgcaagcatgcaaggaaagcagcaatgggagaattttggcctatagatagcccttgagtgcattgatgtgatccgatgcgataccggtgagggactgagacacgatcccggccatgacgacggagatagaagcccacctcgatccccatctagacctgcagtgctgctgtaggcacaggccggttaccttccagataatacatgtctactttgacaatgtctcgacatgccgtttttggtagtggatacgcaccattggcgattattggcacacagacagacacgcaggcaatgcagcaaagcgctactaagtggcgacggcgggtatagtctcccacccgccgacggcggtgggccggatgcctcctagcgacaattctgaagatacacggcagccagcaggttcgacgattcacgatggcttcacatggcaccactccttggagcggtgtgccggcttatagagccagttccgcgggacggcgccggcctagtcagtggagagcggtgagtgggggagtgagcaacaagaaggagaccgaagctatgggggtttggagatgagagtcgttacagtcgcaattccagcttgtggtgggcgagacacctcaatcaaatcgtatcacatcacatcatgcacgaatatgccgtgctgcgtcaattggatcgtcgttcgagataacgagaaaacaaaacgggtgttgcgttgagcggaaagatatgatgtacccgcagactgaggttgccttcgcgcttgtggttaggaagcgggtactcactgccgccttgttgccctgatgcagacgatatatcgtttcggcccagcagtcgatgggccctgggcttgggtgggagctagggactttgcctcttggggagataagggacgaaaactcgatggcacgatggccggactatacattctgggtctctcccgcggtgggtttcgcattggggttgcatctggaacagagccaagatgcaccaccatatgcatgtgcgacgccagttccgaccagagaccatatctatctaatcaaatcatcgcttctgccctctggagtggtgggtggtacgccgaccggagatgtctatgtgtgtgcatgggtgttatgtatgatgcgcgcctgtgtatcgtatcaatatgcaatgcagccttcttacctcgaatcagctcgaggggatcttccccctaaggtttcgattcccccgccactgttgtctccccctccctggttgtccaatccattgcatgctgtgatggaaacttcggaggtcgccgcaagagctcgtgttgatcacggacgtatcactaacacgataaccacgcttctgcgtagcgcacactcgccccctaagcaccttgccgatggggtagacatagcgtccttgctgtagtgcgcatgtacttggtcttcgatccttgccgagtggccaggcgggaatgttgccattggctcgctgagcatgaattgtcggtgaagggtgcatgaaacggatgctgaggaataaggtttgctcaggggttgttgcggcatcctgtttctggaatctggatgctcttcaccttctgtgaggattctttgtgtctgttccaggccggggccgactaggagactgggctgggctccctgccgcgaacaagacggtcggaatgggcattgactctggcgttgatccccccacggagccctcacacgaccacgaccctcaaatgttgggcgattggcgggggatgtccatgtggccttggctctgtgcgggatgacgagaaggatttgcaggcaatccgtggctgccgacgtagacaaagtgccaaccttctggcgattcacatggcgtagcggtgcagatccgctacggtgcgggaggggcagcaggtttggctggagggaagcgaggaacagcactgttaaaaaaataaaactggtaccggcaccacaagcttagctggcacccgggtccacaggacagtgttggtaagcgcggcactgtgctccagcgcctcgtttggctgtactcgcggtcagccaccgtgggagctgcacgttttgcacagtacccggtcattggcgctgcagtggctcgtaactgcgtcaggacttggaggggcagaggcgagccagatgccgccagccccaccagctggggacgcctgtaaaaatggaacaggcagcctggagccctgagatgggctggagtcgctgggggggagatcgtgaggagggctcaagggcttccctccccgttggagccagtcagtgttggctggccgaatgatggcaacgcctcatccacctggtccgttagcagtacctaccagctactagcccacgacggccaggtactattgccagacaccgccgtgctagcactcgcctctgcgcaggacctgctcacacgagtcgccaggtacacccgcaggtatctccaaagtcctcattattacgcccaagccccaatcgcccaccccccaaaagccaagtcactcccgcctaccgtcgtccccttgcctcgttattattgaccgttccttcctaattcttactatttccactgccagttcctcaaacttgatttatggtcctcgtctcatcttgccaatctgccttcatttcctctcctctgccaaaccttgctacaaccttgccttgcacccattataatcacgttgttccattactcgacactcgttgatacgataccgctttgactcattgttcacctacccttgttctctcgtctcgccgacctcgggaatgacctcgtcacactcttcatagactgcccaccaccgagacctgagctcgctcgtttgtcggctttctactgctttttttttccccttcaccacactactgtgcaatgtcaagctccaatgcgccccgacggcgctttgctcctgtgcctatcgaaaccaccttccagtctgtgcggaagtcgaagcagcccgagaccatccacatcggtcccagcgctgagttgaccccagaagcctccccgcgctctcctcactcgcccttctcgcccgaacttgaccgcgagacacacccgcatcgccgttttgctccgcagctcattgagacatcgagacgaactcgccgcctgggcgacgcaggccctgctacgaaaccagccgataagaccgacatcacaccttacacaaagaacatatacactaccaagtcgcgggctagacgaagacttgattccaccttcgaggatgaccacgaacatgtcgagccgcccacgcggcgtgaatccgaggatgagaacgtcaaggcctacttgctagagctggcagcgaaagaggtggagagacagatccaagaggccgccctagccgctttccccaacagtcatgctcgcgagggtggcatcgcccatttctacttccctgagggttctgaaagtgacggctcctcggggaacgagtccccaacgacggaggagcccaaaccagtcagagttcggcgcaagtcgtcagaccttggattgagttggtggcataagcacatgcaagagcatgcccagcatctggcccatgagcgtgaggctacccaggatgaagttatcttcaaggacgatggggacaccgccatggtatccgacgttgatttggacaacatggacctatcccttccacctgatcccctctggactacctctggcaaagtctctccagtcgatcgccgtgactcaatggacgaggatctcatccccccttctcatgttcctgtcaagaagcctaccgagaacgagcagatggtagatgccccccgcccaatgcccaagatcccagcacctacacctttcgctgcagccccaaagatccccgcccagacaggtttccgcggatttggtcgacccctgcccaactacgggttgagatcagactctccccaggctaagaagctgcgaaagctagtctccccacccatgcttggcaaagacctggtgtttcgccagtgcccatcacccaaatttaccaaactagagccaactcaccccttcgacgatgatttggatgcccatcgggatatgaccgggcaaggcggtctctggcatggcttctgtttccacaatgagcccaccgaggaacaccatggactctggtccccaccacctggcaacgggctgctcatcacaccccattctccgggtacgccggctgacgactctgattcgaatgtaattagtgaggagccaagctctgtattctcttcgagtgcttcgaccgagagctctgccacgtccgagcaccgccagcggagtggagaagccaagggcctacatatgctccacgggctcaacgaacgcctccagcgggaaaaggccgaggcagagaggaatgagaagattgcgcaagagttcaccgatgaattcattacgcaggtctacaactatctttccttgggctaccccgctctcgcggccgcatacgatgaggaacttgccaagataagccacattagcatctttgatttgagaaagaatgattccaagcacttggccaagggtcatatggttgagatgactctcgaggatactccagatgaggatagatgccccagatggcgagcgctcaaaacctacatctatgaatgggcacgtcagcaccccaacctcaacgctatggaccctcctgcctggggcgtaagagagagacgtggcagttgggcaatctagagagcaagactagattcttttccccccttacacttgcactatacttttattttcttcttgtttaactacagcacacgagcgttattaaagagcctggtttggtcgccaacgtatataaaagtcggattttaagcttcttctgcttcttcgggtgggccttggttatcggcgagcatttcatgctactgttttcttcctctttctgaacgacaccagagggtacagctagatgttacggttcctttatttcccttttcttcttctttttcttccttctttcctttttcgaaaacttccctttacggaacatatggcaaggcgagcaggagcgatggcatttgaaagcatcattttaggttggcgttgtggagaacacttttctttgcgagaactcatggtctgagaagtcactggtacactctgttctacaccaagtgtataactgttgtctggttagatttaaattcacgttgcctctgggcactacaactatttcaatgcatctttcgcctttacagtgacccaagaggttctcattgagcctcttgtgacatgatactgaccttttccgaactgctaagctacgcacttgaacataaaagctgctgatgaaacctggttgttgactattattcactggcagggcatgagatcacggcgtggagctcttttcatccccgtattgaccgttattgcaatcgcaggcagttcgcatattgatggatggtgaatgtcaacgcattatatttgccagaaatgatgaatcccaggtctacataaaccaaaccaaaaaacgcccagaatagccgcggtaacagcagaaagattttactcatttcctctttgaaaacgacttggctactttttgcaccttggagggcggggcagcttctacatcactctcttcgtcctcgcccattgagtcgtccacatcgtcgtggtcaacctcatcctcgtccaacagggactcgccctcatcctcgctatcgtcaatttcctcctcagagtcatcatcctcatcactcgactccccaatggccccattcaaggcagggacgtcagagtcgtcgtcatcgtcagtcacacgtctcctgcgagacttgaggccgctgcccagctcctcatcctccacctcgccctcaacccagaccacatcttcctcctcgtcctcatcctcgccttggttaatggctctggagcgatgctgcatcctccgtcgcaggtccatctgactctcgagcatgtccagcttccccttgagcgccagcaggctggtcaggcccttggcgcgctccgccaggaccttttgcaggccgctgaggctctgtatgaccttgggctgggaggcgagggcgccgccgtgggcgatgagggtgagctgcacccaggtcatcagagtgcccgccctaccaggcctcctgtagagacgggcggcgagcttgttgagcaggttgccggcgagcgcgctgtcgatgctctcgatggtgttctggatggtggtgcggtcggtggtgtgcaggcacgattcgagcaggtcgacgtcgtcggtgcggagggcctgcgtgaggacggtggtgagggactggtgggaggggggcacgatggcggcccgggcgggctgggaggagagggcgttgctggcgcccgaggactgctgcagcagggcgggcacgtcgatggtggcctcgctacccctgaggagctcgccaaaggacggcgaggtctcctcctcgccgtcctcgtctgccgactcgccgttgtcctctgcggacggcttgccgctgtggttgccgttgagctgggggggcgcctcggtgccggtcattgactcgtcggccatggcggcctcctcctcgtctgtgaagccgtcgtcgctggcttcatcggatgatatctcaatggcgtcctgctgcgagctggggagggcgtcggtgccggcgacggaggtcctcgactcgtcgattacgctcttggttgcccgtctggcgctggacttgacggtgggtgctgccagcttccctggcgctttgcgcttggttgacatggttggttatcgaggcacgagggctggcgctcgtctctggtggttgtgtagataggtagatgtaggtgggcgggatgggattgcggctcagaaacgaacaatcgcttgggaaggaattgaaaaaatggccgaggcgatcgaatgcctagattttcgtttctgaatttctattcaaaccatcaatatgattacaatgagccttgttggcgtcaaccgcaatcccgggcctaagaaaatttcacgaccgctctctggagtggtgaactttttttttgggccactctgcttcgggtcctatcaagccgctcgccccataacggtatcagttagcttgctgataacaaaatcattatcgataatagtcacgtgccttaagcattctctaagcttgcttagtcatcttcacgcttcagggtcgggattctaagaagcaccagtgactcactaaggtcccaggcattagcattgttggatcacgggataataatcgtgaatctgacacatccaaaatcctggcgaaaattttccgttcattttgcgcattgctttttcgcgagattcgcaccagatgttcaatgctttttctgaatatcgttcttcatctatcatcctcaccagtcaatggtgatgtcgtacccctcttaatggcgtgatctcattgattgggacggagtgtgagagatctttcggatgtgggagtgcctcgttgattgaccacatcatagatttcgagagcaatgtaagtcaaggaagctggaagctgcacatcacgtcacgcaaagttcccgatttccttcttaaagaaatattggatgatggtgtcggaagtttgatcgcatccggaggacgccacctgtccggatggatctatgcggtgcttgcgacagattgcagccttgtaatattaagttattaacacgtatctccatccgcaagtctacaaggaggcgtcgccttggtccgtacgactaagtgggcccaatcgagcacgatctggagcaccaagggcttgcttttttctgtcgcagcctaagggggggatcatttttattacgacgagcgaaaaaggttggcaaggctgcacgcccaaggctacacatccatgcgacccaactgcctctcctctggtgagatattatccacagtgagcaggtgcgactgctggtaaataatatggcgctagcggaacagctccttaccaaggccagtacaaaccatgggaagatgcttcgggaaggcgctggaggctgtgatgcagcaggtgacagctgccaccgcccgagagctagcaagcttcataaacggtgatgcgtttgcgaacccaaaaaaaaaaaaaaaaaaatacaatcgactttgccaacgctccgtttgagagggtctgtgtgttgtgaacactcagagctctcgacgcgcacaacatccatcgcattgtagagcgcgtccgggcacgcactgaccacccccgtttcaacctaaacccccgttaaagcggagttcagaagttttcccagccattcgtcgccccgttagaagcactaaaacggctcaccggactttcccttcttctctcataaataccacggcgcctcgctcggcctataattgaaatttttttttgacgtgctccgcgctttttcctcacggaccctcccacaccaccattttctgcctatcctgcaccaactgcgcaaccgctgccggcctgcaccgtatataataaataaaaaagaaaggtacatctcccaccacccaacccccacccaatcccttgtacctttaccaaccggtcgcaatgccaatcacccaagccttttggcctgcgactcggcaaccagccgaaagcagctgcgcccaactgcagtttgcagccaccacctcacacttgccctcacctggggcgcatattcgcctcagctcgcattcgccaaataaaagctccctccttcccctccttcatttgcatcactcatttgcatcatcttttctctctgtcgcgcctggcgcacgcgcccttgcctccatacccacatcgcatcgtcgcgacttgaaaacaaaccgagctacagcatactgacgcgtgttttcctccatcatctagcttgccgattcctgggatcatcgcgacccttattctctccttacgtccgtcgagtagttaaatcgcagctatcatttcgaacaatatacctgatatccacaaacacgcgcgaatcttgaacacgtcctccctgagctgcgcatccccccaacagatcgttgcgcgcgcgctttccatcgctcgtcgcatttgatgttgtgttgcgccatttagacttgaccacatcgtcagcgctatcgcgtcgcgtgtggcacagtcatggcctcgccaaagccggagtcaaattccacctcgcctccaaagcaagtggatgatgcggcaacgaaagaatcaaaggcagaggtcaatgggtatgtttgctcttcatccccatgctcgctgtctcgttgtgttgtaaagtcattagatgttgactgtagtcttttctgtcgtactagccatgcagacaagtccgaatcgaagtccgaggctgagacgaagcccgaaaagcaactctccaacggtactggttctggggaggagaacggcactcccaatggagcggacaaggatgtggagatgaagaacggtgacggatcaaaggacgccccctccacgacagaaaagtccgaaacctcagacaagaaggaagccgaaacgaacacgacgcccaaggagtccagcaaagacgatgacgtcgaaatgaaggagtccgagcccgccaaggaggcgtcagcagcgcccagtgacgaaaagaatgatgacgatgccaatgagtccacgactaagccgacagaggcgggcactgaagacccggacaaagccaaagatgcgcaatcttcgcctggagatgcaggtgagtccgggattgatcttcaacccgccagtctctcgcagttggctatcgatggaccagaacctaacacatcaccagttgagccttccgtggaagtctccatgaccgatgcgcctgcgtctaaggtccctagagagcgcgaggacgacggcggagaggaaccagcaccgaagagagcaaagacggaacccaaagaagaggagccaacggcatcaacgccgacggcagatggtcaggaaatttctgtcatgactgaatttccgaagcctaagttcgatgagttcactgagtggtacgatgcgaagaatagcgccaaggagatcacgaaccatcgcagacgggaaatgcgccggactgttgcccgtgtcaaaaagacgaagcacggtggcgagtttcgagattccgtccagaagctctggcctgcgttgtgggaaaagtactcactcaagatcgagaagccgatggacttatccgaaatagatcgcaacttgcgagacaccaagtacaagacgtacggtgacttcaaggccgacctagctcttcttgtagagaactcacaagcctacaatggccctgatcactacattaccatggctgcacgcggcgctagcaagactgtttgggatgacgtcgttttcttgcccgaggaggagccctcaaaacccaaggctccccctaaagcaaatcgcatgcgagaacttcgtgttggcagcaacgtcaagcccgaggctccttcagggggttctacccctactccgaccacaggaccacctgccaaggcagcccaatctgtgggcgaggcgaggcggagttcttcggttcatgacggcgatagacccaagaggactgtgcgtgcacctaagccaaaggacattgactactcgtccaaacctgcgcgaaagaaacttcgaccggaacttcaattctgtgacgaggttcttgcagaactgacttcgcagaagcactggtctctgaatcaatggttcctcgacgcagtggacgctgaagggctgggaattcctcattactattccgtgattaagcatccgatggatctggggaaagtgtccagaatgcttgcaaatggagaaatttcgagcctcaaggagttccacaagaacgttactctgatgttcgacaactgctatcagttcaacggtccctatgagcaaggcggggtctcggcacttgccaagcagctccaggatatatataccgcgcagatgaagaataaggatacatggctcgccaaacatgcgaaggcaaaccctccaccagcttcggtctcaaaccctagtgatgatgatgatgacgaagatgaggaggacggagaggatgccaatgctgttgctgatcatacgcgggcagtcaaggaactagaggcgcgacttcgagaagaaatggacaagcaggctaatctcttcgccgccgagcagccaaaccaaagcatgatcacaatccaacagggaatcgtatctatggtccaggaggcgcttctcaaggcgaagacaacgctgaacgaagtcaggcaaaagaaccccgctggcaagcccaagaagtccaagcctgcaaaggcgaaggctgctggtggaggagcaggacgcaaagctagcggtgcagctgctcagcccaagaaggctggcgctggcccggccaagaacaagaagaagaatctcacggctgccgacaaagaccatattgctggcgcgattaacgatctcgaatacccgcatcttgaccgagctatcgatattatcaaacgcgataccggtcagatggtaagttgcacctatcaagtcctatccatcattagcatatactaactcttttcctgcaggagagcgaggatggcgaactcgagctggatatcgaccagcttagtaacgatgcacttttgaaactctgggaactctgtaagaaggcgttaccaggctttgccaaggatgcagcggcccaatccccggaggtccatcgtgctgctccatccaaatcagcgcccaagacggcggctaagccaaagaagaacaagccaatgagtgccctggagcaagaggcaagaatagctcagctacggcaaatccgagacatgtacggcaagggcgacaatgggggcgccgctgatcccgctcgagctgagtcgcaaggaccgatgtcaagcgacgattcttcagaagaggagtaggcgacctaatgagatttttttttgcagtcttgtatgagtatatgtagaagcgtgacaaggaaatggtggtttcggctcctttttttttcttagccgttggatggcagttcagggcgtccgacttgacgcaaaaccgcagatacccagttcttctcgggtcgctttgggttctatccctgtcgtccttgctcacctgcgcaagcgagggcgtcaacggcattgtgataatgctgatctattttggtcatttctttcatcaacagcaacctgttaacttgttgtaattggcgccgaggggagggattgacgagggctggttacccggcttatgttcattgatgtaggggtcattcagatgcaaacggagcttcgggttgatccagggataacaagcccagagagaaagcacgaagacaaccgtctcatcgctctcatcctggaaaggggtgaaaatggcctggctatacatcttgggagggcattacctatggggcgagggtaaaaggcgattgtgggtacggaggtgaaatatgccgtcgaattccaaaccttcgcatggaacgcttgctgatactactcggcagcaacattgggaagttccgagatctattaggtgtggggagaggtttgcagtaggcgcctctgcaaaatgtacagagtccgagaacaaataagaaaaaaattgatatcaaaatcaaacatgtgccacatttgccaattactggtcatgaggtcaagttatttatatgcatgacgagctaagcttttatccagtgacaggatggaagtctaatatcatttctaggtggcaagggcctcactcattccgcctggtcgggcacaagaggcacgggcagtgtccttctcagcctgctgcagatttcagcatacgcacccgggccaacctcctccggggtgacgatgccatgtcgcaagaggaagtctaccatgacgggacacacatttggcttgaactcgccggcctccattctcgagatgacctcgtcgggccccatgagctcgaacctctcaacctcgtcgtcccctggggtaggcaggacgtccgggggcatctccatgtcgtacacgtacaggacctcggagtggtacaggctcgaggccgggttgatgttggccatggtcaggacgccggcgggcctgcactcggcggccacgagggacgggggcagcgaggcctcctcgctggcctcggcgaggatgcaggcggtcggggagtcggtggccttgacgccgccggcgacggtgctgtcgagcatgcccgggtaggtggcgaggtggcggctgcgcctggcgacccagatgcggagcccccctcgctcctggggggagcccctgacgaaggcggtcatgtgggcgccgcgggtggcggtgccgaagagggtggccgcgaagcgctcgacgtggacggggccgggaccgcgggcgccggggatgaggaagggctcgctgtgctgggcgcggaggtgggggaagacgtctgcgtcgatggcggagtcgatggcctgctggatggacctgttgatgtgctgcgtgcgggcggctggcgaggaggatgagggtgagggtggtgaggctatggtgactgtctgggcgtcgtggtcgatggtgacggagggcggccagggcatgctggacacggtgtttgggtggatgaagccatggggtctcgggtcgtctggggagaggtggaagcggtagtagggggagaagttttgctcaaagtccagacggacgctgggttcacgcgtgtaagtgtggtgtggccctggcggagagtgagagtactcacttgtcaaaaggagtgatcagatccaggaacttattcggaggtggaggcattttcaatcagttcagtgtgttggtctagagctagggctttctgtgatattccttttcccaagtgaagacaaggttgccgttgctgatgagtgaattatattcgtctctccaactcattctcctcaacgatggccatgataaagcccaagcgctgtatgtgctgactcatcgaagcatactccttataggtaaggtaagtagttcgagcagatgctctgcgaagtcattttgatgagcgattcgagtgataagatacaaacgcccgattggtgttcagcccagtcatctatatttttacagcaacgtacagatgatgtgcatcgaaagggcagctccccgcaagagggtgagtgcccctctcgtgctatagggtaggctatctgcattatggtccatggatctctcttggcctctcttcgtctcactggatggatgtgagaccaaaacaacaataaagtttgatacagtcagtcatgaaatcgataaaagaactgcatcaggcaggctacattcattcttacgaggtggcgactttgttgtacatgtggcttgagttgcatgcaccaccatcctctcatgaaacctgatatcagaacgcatctttcaacctatttcgtggtaagactggtaggtattggttttgctacggtcatctctgcggctattcggctcgacggagtgacagtattactagacatgtctaagaaactgccacagagcacttccatcaagtgatcagacgtcagattgtctttccgtgcaaatgacaacagtatacttttccggctaggatagatgcacgtagtcgccgagcccagcagggccagaacaagcttcgggggaaggcgtctggggctgtcaaaaatccatcgcgggcagggaacggactctggccatgtcatctatttggctagacaagtctggcagaacactaacatccgtggctcgcgccgtgtacgcatgtgtagcgtcgcgtgcgcgtgaagcccgtgtcagtctagaccgcatcttgtctgggcctcgtctgatgtgcttaaaagtaggttcttacgggcttttggtgccagtaggatatggtttttgggggggattggtcctcgccgacattaagctctggtaggcacgaaattattgcttagtttgggggtctcacagggctgttgcactaaatgttagggtgcagcctggcagcttgccatctgaaatccgcccaatgtctctgatttgatacagctcgactgagacattgcctgtgaggatcttgcctacttgacacatttgctgttcctaagccagcaggacaaggatcgtgaccaacggaataagaagcaaggggaattaaaaattaccaaaaaattgggtacgcgctcaagtctcgccaatctacggttgatgagaaatgtctcatctctgtcttgcagactagtgcaaatttgaatcatggttttggcagccgtgatttgatttcaggctttcagctgggcactccgagggctctgactggcaaggagagagcgaagggagacagacggcgtttgacgtggcttacatgtgggagcgcagccagttacgagtctgacaagaaaggggagggcccaggacgggacgtgacccagcgccacaatacgacagcgagatctgatatgcagggggaacaaagaagggatgataaggggatgatgcagatgcacgagcaaacccaaaagtgacacgagcggcgactaacaagagacgtggatgacagcccccctacaggttaaagctgctgggcaacagggctgagagagacagctcattggttctggggatagacgtttggccattcgcggcgtcccagggctcgcacatggcgccgtgacattccctgcggcagtcggcctagcactagacgttaagagttcagttagcggagcgaagtggccggagcagaccgtagtgtggtgttaagcctgctgtgcgactccacgtttgggtcccgtggccaggcgagccgaatagacggtcaagcctggtcagtcgatgatgggcgctggaggtcgcatgctctgcttgttcgaggccgcatctgggcctgggaggaacgggggtggcgatgggtgcgatagggatggaggagagggatggagtgcacacccataacccacagtcccaggactcggggcagggatcatgacagcgaaactgcgacaggcatcaggtttgatgcaacgcggtgacggcacagggccgaaagctcttccacatcctcccttagaaaaggatttacccgggggctgtcactaatctgggcaacggtctgcttggggtttgcgacggagcagagcggcacacgtagcagcattacgacatcgatcgctgtatatggcagtggacaaggcaagaaggcagcaagccaggcccgacggagaaaaaaaggacggcagaaggggaaacaagcagcgcggtatttgcgtgcagagcagcggggcagcgtgtcattgccgtcatcgatgcagctacgggctgagaagtgcgcgactgagcaagctcatcaagcgaagcaggcagcgcacagcaacacacgcagagctgaggcaaaagcaacaagcagctcagtccagccagtcgcgggtcgcggatttgaggtggagcgctgttatggggaagccatatgtgaagtgtacttcgtatgtacggggctgggttagggcagtctcgtatttgagatgagtagcagttgggtatcagaagcaaacaagctcgctagaagaaccggaaaccccaggaccagaacgccggctggatgcacagagcaacttagtcggtcaagcagccaagcaatcactaccgcagacgggcgctcacagctgctcccgtaagcaccctcctcttcgctcccaccaccacgacgtcccggagagcgctagattgttagcctggacgggtggataaggtagacaggtattaccttttagcggctgtaagagcttgaaaccacctcgatggagcagaaatataggtagcatagggtgccacagcgacgtccagagttgccagctccctcccgtcccccttccacgtcgtgtctctgttctgctccaggtctgttccaggccagcaagtaagcctaccgatcaagtcgtacgacatttcgccgtgctgtcccacgatacgcgagccagtgccggacgtcgagacagacatctgtgcttgcgatctcgttccacgcacgacgttgggactacgccggggtaaccttgcgtcgctcgtaggtaaggtaccgtgcttctcaggaccagcttcatccgccagggacggcccagatgctaaataaaatactgtcaatgctggattgctaacagctctggactgcagcagcacgaccgggtccagcccagcagcggcatcgtcccgattcgagaccttttttccttccctctcgcttcccgttggccctctccttctctctcttcccatcctccgacttcttcacttgcggtgtggctttttttttgtttctactgcgtgtccatcctttgttgctcgagcagccagccggcaatcgctatcacgtccaattgaagcttccctgttttttgcgacaaggcgctgtatgcgctgctctggccactaaacggtaccttgcgtcgggagtatacaatacttaggtaatacgccccatcctacccttgctacatataatttctttgtacatttgtgtacacgcgacacactccattgcatttcctgttttcagggacctgaggcaggcgcgaaaaggatcacctactgacaacaaaaaagcaaccaccaacattgaatcgcacgaggcgcatcaagataagacagtcagactacccctccaatcagccagcgggatcttcactgtcgcaagccatcaaaagggaacgcctttccaagctattctttcttcagacggtctcacgtggccctatcgcacaaacgccgcgcctcgcaccggtcttccagccttgactcgcattcgaaccagaacgaccatctatctggcttggtctagcggcgccgccctgaggtatgacaggagagacataaaacttgctccctcggcaacaaaatttcgacttgcgccgcgaccaagatttcttcaatgtctcggccattgccagctcaccagccacacccacagtcgttgccccatccgtgctattaaggcatcggcgactgatacgagcccgactacagtgtattagcactccaggagacccccaaatacgaggttcacagccaccccgagcaattcagcatcagcgcccctgtacttcgccatccgcgggcgattgaaaggagggatacggcgagacagcaacgggcggacggccccaaaattccaaactcctgggtgggtattcactactgccaattagcaacagtcttcagcgagtggaagggtggcttgctgcccaaaataaccacccaaaacaatggcggcagccgagccagcgtgttctggaaaagtcgccagcgccagcgacagcagcaggagcagcagccccaagaccgatgggcagatcccggccatcactcccccgacaacagccacactgtcggcaacctcgtctcccacgtctggcaccgcgatgcagaagcccgcactgcgccagggaccctccggattgactttgcagaccgctatcctcgaacacgagaagactaaaaaccttctaggccgccgcggcactggcgaggaattcatttccgccacctcgccccagcgacccggtgccagggtcaagccacagagccagggcctagatacggacgcactatcagcccctgacaacggtaatgcgacgccaacaaacagcagtgtcccctccgtgctgtctgaatctcctcccctctgcgtgagcagcattcttcccaacactagaatagcacagccaaagcctatcgccgttcctgtctcggcgtccagccccctctccctcagtcctacgacccccttgccggatccgtccatccgctccggtgctcctattggcaacatcgctcgactcgaggccactgcagagagactctcgaccggcaccagttcgattggcgatgcgatccgcgagttgcatggcgaattgaagcgaagtgacagccgtcgatcgtccgtacgtgctgccagtatcaggacatccaacgacgaccagtttgccaatgtgccacccgtccctcccttgcaccgccatctctccagcgcatcgtctattctcactacgaacatagccgcacggcaaggcggctattctcctgcaggattcgtcatgtctcctagccactccctgactggccggcttcgatctgggtccaagaattcggctggccgaccagagatcgatatcgagcctccactctcccgtcacggaccgggcaagacctccgtccgaagtgttcgctctgccaagatgtctctggctgagatctccgaatccgaacctatatcattaaccaaggatgccctcgatgccgccgatgccgcccctccgatcgagaccgagcccctcgacgaaatcaagccctccgagcccaacgaagtacctaataaccgtgccagccgtatcctggaatcggcgctggagctggagatgggcgagcccaacctagatctgggccttacgcacccagaagaccagaaacaccggcctgttgatgagcccgagcgacctggcagcgcgcactcctacagcaccttccagcaagtcggggacgcctttgccgactttgatggtgtgcattgcgtagaggatggcacgtttgaccgtggccaccatctggaggaccagacgatcatggaggacattcccttgggcgagggggagatggagccggtacctcgtcagcgccgtcctgaacgtgctcggccgcaatcctatcttgatcctgaatcgggccaacaaatgttgttctacccagcacgggttcccgcgatgctcaagcttccaccgaagttgtccaacaagcccaaagtgactgatcgagacaatcgacgatcacaggtcctgagtgctatgctggaccccaattacaactatgaggagctaaacgatccagaagcagcgggtcgccaggagcctcctgtaagagactcctggttgccagatcctcttgctggtaatagggaatcctttatcgctcttacgtcgagtgcaggcttgatcgatgccaaggaaatcgagccagtggaggaaccgatgcccgcagagccggactcgcaacacctgcgtcgaccgcagaagattgggcgaaataaggcagagaaccggaaatctcgactcgacaagcttccgcctcaactacgagcgagcgccttcttcgatttaccgtccacgtcaccaaaaatggaggtcaaggacggttcggccatggccactcttgatagcatgcttgacgcctccatgaacgctcccgtcaatgcctttactaaccatacattcgcgggccctcttgggccagaggtgtacggcaaggagaagaagacgaagcccaaggccgcagcgaattctctggcacccccatctccacagaaggagcccaagaagagggcttccttcctttggttcaagcgcaaccatagcgaatcaaagatcgacagcaagtcctcgatgggcgaagtcaatagtgacactgatgctcccgagacggcaggacttgcaagcagtcacggggaagaccaccccgacgacgacgacctggaaggtgaggacgtggaaggagaggaggagagcgaggatgaccagcctgctggccctccaacaacgctgctcgccgaacttcagctacgcaaacagcaacagaaacagcgaacccagcccatcagccaaaagttccaggatggcatgcatgccaccttgctcgagatggatgccgtggccgaggtcgagcgcaagaatcgaaacaagaagcgtgtcaatcttgcctgggaggatccaggtgctcaccacaacgaaaatggctccgacgacgaggacgtccctctcgctatcattgctgcgaaacatcaaggtgctaaaaatatggctgacctcgaacgtcccatcggattattggaacgccgtgatattgaagataatgagcctcttagccgaaggcgggcacgtttgcaagggaacgatgcgattcccatgacactccccaagcgccagagtgtcgcaaccctaaccgcccacctcaccagtccttatttgcgggtgcagcctcagacaccaggtagcgtgtccgagcaagagcctacagaggaggagattgaaggcgagactttgggagagaggaagcgccgcttggaaggcaaggagctccccaaggcccgacccgtcagcagtgccttttcagctgagcttctgagccagtttggtgatctggaggaggcaacgaagcctggcacggccgatggcaagacaaaggagaatagtgagcctgcggcgaacccggaggaggagactctgggtgagcgcagacgccgtcttcaagccgaacgcagagcgcgcgaaatcgaaatgagccacaatgcgctcgttggcccgtccgagcccaccgtcaatcgccgcttaagcatggctgatatgttgtctgcacatcctaagaaggaagagaacccggccaggctcgaaaagctcaagatggaccaggaagcaatcattgcccgcgatcgtgacgccaagcttgcggcgatgcgacggcagatgcccacatccatggcagcacctactatcggtggttaccgtggcggcgtttataatgacggacatggcggcggcaacactgggcttggccttcagggtgctatgtccactcccgcccttgggcagacgtaccctggcaacacccaacacagatctgtaatgggacttagctcttacgggatgcctggacagcagcccggatacgtacacaacaacccatatggtggcatgaacggaatgaatagtatgggtaatctcaaccggatgacgatgaatccatatgcccataacagcatgcatcaactacctatgcaaacgcaactcccgatgaacacatcgtcaatgagccgagtcgaccaatggcgtcatggtgttgtcccttagtccaattatatatactctctgggcagggattctactggagtctaccagtccctgaccatatagggatactggccctgggagagtatccctccctatcttgtttgcaagaacaaaaacgttgagaaatttgcagccttttctttttccttttagcatacctacccaccacacttggcgctgtaccatacacccttttttttctttgtctgtataccaacgaacacgaggactgatattgggcattcgcgtggatcggagaataagtcgggacggaatatttggttattgtagcctgtctagctagcttagcattgcgtggcgctgggaagtgatcttttcgataatttatagtcataacaacatttatttacccctgggttacggacagttggagtagccaaggaggccttgagggctctcgcctggggctggacaatacgtccgttcttttcatcgaggcatatagactatagtagcatagctttgtcggtatacgcgactagtcaatccaagaaggataaaaactctagctgttttgttttccaattctgatccaaatttgtgtctaatgtgatctatgttccctctatatcgggtctatgtctatcccaagtctcacgtaaattgcagtctctttactgtgcttttcttttagcttgctattcgctgctctcatcgatctggtccaagacttcaagcaggggaattttatgaaggggtataggtttggtgttcttccagaacttccagatcaggaagacggacaaaaccaacggaatatccctggaggaaaagagagtaggtcagcatagtgaactgagtcacggtttcgatccgcccaaagattgtaggcgggccgggtgtgtacgtacaggtacgaagagacgaagacgctcgtgtcccagtgtcccttgatgaacgtcgagaagccgctggtgaacaggataaggacgcacatgcacagagctgcgcgagaggtgtacactgcgccaatgttagcttcagctacattttcccttctttctttgggtttgaattttaacgttacctgtgtgcttgttgtaccaggggagccgggattcggggatcccctggacgcgcatggcgctccgcaggcggatgtggttgtacagtatggacgaccaggagacgaggatcccggcggcggtgaggtcgacgaaccaccagaagacgacgagggcgccgctggagaggctgaggaagctgaggagcatgaaggcgccgaagaggaggacgcaggcgtagggggaaccccagctcgtggtgcggaggaagacgcggggcgcctggcccttgagggcgaggccgtagaggacgcgggagccggagaggaggctctggttggaggcggaccaggccgatgtgatgacgacggcgttgacgacggaggggatgagggggatgcccgcggcggaggcggcgatgacgaagggggactgggcggcgtcgccggcggggccgttggcgaggcgggggtcgttgctggcgacgagcatgccgacgacgaggatggcgagcatgtagaagaggaagatgcggaggaagacgcgcttgcaggcggcggggatggcggagcgggggtctttggtctcggcggcggccatggcgatggactcgacgcccgcgaaggagaagacggcgccggcgagggcctgccagaagccgaggaagtgtcccaggggtcccgggaggatgtgctcgacaaaggggcccgggtcgcgccagtagcggaagccgagggcgggggttcccgggatggcgcccagggcgatgaggaggccgaggacgatgaggaagacgatgaggaggaccttgagccaggcgaagaggtactcgacctcgccgaagacgtggatgcgagcgaggccgacggcgagggtgaggaggatgaagacgaggatgatgggggtcgggttgacgtcgggccaccagaagcggaagagcacgcagatggcggtgatctcggaggggatggagaggatgttgccgtagacgaggttgtagccgagggcgacgccccaggcagggtcgacaaggaactcggcgtggcggacgtaagagccggtgacgggcagcagggcggcgacctcgcccagggcgaactggacagcgcagacgacgaggccgatgacgccgtagccgaggagggcgcccaggggaccgccggtctggactgcgccgccgagcccgaggaagagtcccgtgccaatggcgccggcgatgcctatcatggagagatggcgctgctcgaggccgcgctggaagctgcggtgctcctcggcggtgacgacgtcgccgctggcaaaggggtcatcctgagcgggcacaccgggctctgagtcgccggctggaggctggagcgggcgcggaagcagggcatcgtgctccgtggggatgatgccatcgtggtgttgaacggtcatgatgccgtttttgcctgccggaggtggccgaccgcctgcctccctctctgctggggtagagatggaatgctagccgttgggcgggggtcaggccatgagtctggggttgtagatgctctgtttctggtgcctctggggaattggaaggactgggtctgagtccagatggatggtggtgagcagatgataagagctggaggtcaattgcgccatcggaggttgacatttcgagccccactaccgcgtcactgcgcaggatggagggttgcacagcgataatagaactgttttctctacaggattagtgacatgaaagatatatatttcactctctacattagtcactgggaaggaggaataacttgaatttgtgttttaggggacgtcacggcgagtgaaagtaggtgtgaaaatgaaatgaaatgagattcgacgagatgagatgagaatgagagtgaggatgacgcttagagtgaaggcagatcgggacggacctctcgtagtcaaacccgtccgtttccagccacggttcctccctgcctattgtctaataagaatatcgggaaaggattttcctcgcctcaatgtctcgcgaaagaacacgaacaattgatcgacgctacgcttaagcatgtcttagctctcggatacccctcttatgaatgaattatcctagtttatgcatgtgttgagccgttcttgccgttatttcacctctttgttctttttcgtactgtttctgagctgcaagggttaatccaagccccgtaaaatgaggcaatgagtattgatatatcatgtacctgacctcatctgatattactattgaatgggaatccatcccgggtctgacatataagacacccgcccgtatcttaaaataggctggagcaagacggactaaatggctagacatttagacagacaaagagcggtgttgaggtggaaacaccgtcggatggaaaataacgaaggaggttgtgtcattctatcatggagcaccacgtatgagctgaggggtcggattttcttcttaaacttaaataccgccgtgcctggtccttctatcatgtaagcagatggtccgaggtcaaacttactgaccacctatctggaatgtaagcctaggagatgatttgggacgacatcgtccgtgcagtgacatgcatgcaaggtttgataatgagatgatgtgaaactccgctccggctgtggcgaacggaataagaaacaagcatgggacgtacttatatatcgtatgcgcgcctttttgctttgccctccttcatttcaagacctgtggaggaatctgcatatactcatatccttccatgctggttctcgtaaatatgattcccatcctcctcgccgtctgtctccttgtcacttcggccacggccgtcccgcagatcgtcgatctttcatacagacagtatcgcgggcaagagcttcagaatggactcacccaatggctcggaattcagtacgcagctcccccgatcggagacttgagattccgtcctccccaggaccctccagtcgtccaaggcgtacaagatgcataccacgtaagttcaccttatcccacccaaaaaaaaaacccctagactaatgagagccatgcttttagtatggccctgtgtgcctccgcaccggccaggacccttactacaaggaaacatccgaagactgcctctaccttgacgtcatggccccttccaacgccacggaaacttcgaagcttcccgtgatggtttggatccagggcggggctttcaacgccaacaccagaccgcacttcaacagctccggcctgatcgccgcggcccagtacgacatggtggtcgtcaacttcaactaccgggtcggcctctggggcttcctcaccaacggagatagcatcacggccaacaacgggctccgggaccagcgcaaggtcctcgagtgggtccagcagcacatccacaagttcggcggcaacaaggaccatgtcgtcctggtcggcagcagcgcgggcgccgccagtgtgagcatacacatgacggcggacaacggcaccgaccgcggcctcttccacggcgcgaccctggcctccgcctcgtacgccaccatcctcaccatcgacgagtcccagtaccagtacaacaacctcgccatacgtctggggtgcaccgtcaaggacagcctggcctgcctgcggaacaagacggccgtgcagatccaaaaggtcaacacgtacaacctgcccctgccccgggccgccaagccgcccctgtaccagtggctgcccgtgctcgacaacgagttcatccccgactacccctaccgcgccttcgcggagggcagggtgatcaaggtgcccaccatcatcggggacgacaagaacggcggcaccgacttcaccgagaggaccacggcgagcctggtcgacagcaacctctggatcgcgaaccagtacccgaccatcacgccagacatgtttggcgaggtcaacaggctctacccgaacaccaacaacacatgcccgaatgcgggatgttactggaggcagctgagcgacgtgtacggcgacataaggttcatgtgcccggcgctgttcatgtcgtcgcagcttagggcgctgggctcgtccgcatcgtactcgtacctctggaatgtagaggacccggccctcatgagagagggactaggtgtcccgcataccgtcgagacggacgctctgctggggacccagtacggcaaagaaggcgcgcccgagagctacaagccgggaggtatcaacgagatggcctcgccgatcatgcagggctactggacgagcttcatccggtcactggacccgaacaagcatcgttatcccgggacagcagagtggcgcaactgggagacgggatcgccccggcggatcgtgttcggtacgaaggggaagaccgagatggaggagatccctcctgagctcaaggagaaatgtgagttttgggtgaagtatgggacccaaatgctgctgtagttagcacagtcttgggaagccagaatgaatcgtaaagagagcgtttttgccttgttcaatcattgactttctgtgtagtaatgtcaaatccaaatattagaacaaactgtgatcaaactcgatgccgtgtccgcttgacaattagaaacgtaaagtccaacctctcgcattcccagcccttgcctcatttctcgcctatcttctcagaccacacatcggaaaagatgaaccgcccaaataatcatgaaatgttgctggtcccgctactgccactcaatccaatgattctcccatcagcaggcactggagaaagtccagcgtggcaagcaatgtcgtcagcagtccatcctcggcaagcttaaagatctgatgcttgcggatcgcctccttgccgaattcgcgctcaatctcaggatcatcgtcgtagtcaagctcctcccggaactggaccaagtggctagccacatcacggagtacgtccggactgagggaggcgaacgctgggtaggaaatctgagcttcctgcgcattgggagtgatggacgattcgatccagtccgagccggtgttggtcaggctggtcgagatgacggcgctcagagtatcgaggatctccatggccctgagagcatcatttccgtttttgctcttgaagcagtccaggttaccgttgaagatgggattgacgagggtagacgtggcctggagctgatctttgagagcgtacagttctcggcggatattaataatctccgggcgaggatcctgacgacggctctcggcattgttcgactcagaatcgcactcgggaaagatcatgaacttggtctggaactcggagaaatcactggtacgggcattagaaaacagtagggggggttacgacaatgacaggacagcacatacagtttcataatggggagaaattcagtcagggtttcagagaggtcctcaagtccaaccaggtagtcaacaaatgcggcggcgacagctggtgtggtagtattattctctgaactggcatgagcaagctcagcctgcgttcgcacctcgctttgaatatcaatcatgcaaggctcgaggctatccatccaactcatcagcccggtgtgcaaaggaatctgatctgcagccagggcctggccatgtctcgtccagtgtttggagtatgcggcgaggataggttccaagtcgttgaagtgatcggagaggacgtgcaatgcgtcctggattttgcacactatcgggacattgaacgagggaaggtcggtaatagtctgctgcaactcctcccttagctctttcacgagcacggccagggattcgaggaccgcatgatgctcgacagggttttcggatgaatctcgaaccgtgccctcggaggtttcggatcgggcatctccttggtcgtcttggtcgtcggggcctgtcggttcctctcttcttccaaaaacatcactgtcctgagatagagaaagcgggtattggctcgttggcaatggggaagtgcctagcccgagtgtggcaggtcgaagcggcaggtcgattgtggaggtgtcattagcgctgtgggtagcagtaacggtcgcattcgattctccggggacgactgcatctggatgaagtgatgatgcagttgttggtgtatctgctgctgtgggcgggggtgctcgggagccgactttcacgatgctcgcttcatcttcactaaactcgtcgtcggaggtaggcagcgatcggactgacaggttgctgtccaggtcctgccagtcgtcctcgatctcggggcggatgacgtaggctgtagccatggagacgacgggtttcaacaactcgtttggggcatgtggcaagcggataacaccgcgcagtcggtcgggtgggatggaaacacggtgccggatgatgtattgaagaagtttggtcgaggtggaagaggggcaatcgacacgcaagtaggtacgcaagagcttcgtcggtcgagggtaggtaggtggtgaggctgacaagccacctcacgtttcacgggctgctggacgcctgagctggacgcctgggagacggtgtcctttggagggagccattggtactacaggctccatcactatgcgctgtgctgatggtgatacggcaaggcaaccgccaatacgctttctgccagaacgcctttgatctgcgggctggaggttagttcgcccatttatactggacggctcggcgggctaagggaactgtacccactggagcttgcccaagttatccgagggcccagcggggttgcccctggcttatgggctgttttctggcgctccattgccgggcttgcaggggtccagcaggttgcctttgagccattgcggaccatcaccatccgcgtcaccacaggcgaggcgtcttggagggcttcgactggatttctttgtgttttgttggtagttgcatgtgcatgtatatatagaggctggcttaaatcccgtctacctttgatttcattagatatcataatatgggaagaagtcgtcaatactggcgagtgactacaggtaccctatgcttgaccatgtatctttctctcatcaaccaagcactaccctctctttgccacatgccacttgataattgcttatggctagaaatatattttcagctaaaatatgaaactttcacatcacgctacataagatgctgtcaactaaacatataggaatacgaatgttatgattcggtgcgcagtctaacgaactgtaacgcctccgttctccccagctaaagcagctatcaatcaatatactttttttctttcaagatctttgatacgaagcatggtgaatatattaaaataacagacttagcttaatagtccaggaatgtagactctgattgtaatcttctctcttatataattgtgatctcaagctctggcaaggcctggagaactccccttgcttcctgttcagacggcatcaggattttccacattccacaacgtgtgtagaatctactgtcaagcttgaaaagagctatcccgtacatgaaaacttcgcgggccttgttcaaggtcggagtcaaacagatcgggagcaaaacagtctgagtgtgcttcttcatatcctcttcggtatcaaagcgaatataccactcgtacaggtgaccggcgtcctccggtgccttgacaagacagcctcctgagttaccgtcctttagctccaagacgttcatctgggtgctgtatctagctgtgagaacatattgtggcaggccataatcgttgtagtcgtcatagcccagcttcacagtcagtaaattccccttcagagtgagtctaccagatataactgaattcatctcattcgtggtgcagttggcatcaatgaattcacagagctcgccattcacaattccctccatcttccggttgtcatatcgaatgacaccattgacggcagcccagctccatgaagggccttgagactctgtcggtcgtcgatctgcaacacattccacggcccagacgagggccttgggcaatgtggccttccatatcccagcgagatatgtatcatcacatccatattcctgaagttcagcctttgtacctacgacagcactgtcaacacaattcagcctctcctctggtgctgtcgcagtacactgagtagatgtattcaaaaggttaaaccaacgatccagagtgtatgcttgagggtcggcggtttcccagtacagtggcaggaccatgacaattggtttccaagctggttgaggcagcaacaagtcaacatctttgttgctcccctgtactaagccgtgatatgacttgggtaggagcaccatgttctctggggatatctcgctgcattgggccccatggcactcccagtatacaagagaacttgcaaaatggaccatccttggcgtcaagagacgttctcgcagcccctttgcagctttaaccaaaggctcatcccggaagtttttcagatttggattatcgagtttcactaagcctttggtcccgcccgcgttaagttgtacctgtaatatggtaggcacaacgagctctgatttgcgctcgacgaataagccggaggaaggcacagctgatcccatagcaccaattccgcagaagctatttgagaaaacattcttcacctcttcgtgagaatgcgactgcagcctgtcttgaggaatacagaggtggtcgatccatagatggcgaagacctaaacgtgcaaccacagcaaaggcatcctggtaagccaatggaaggattgagagacattgaggccgagagagagtctctagtgtagacgccatgagtcgcagactgttctcttccaacctataacagtgactaagcgtacagtagcgcacactggctcgggattgaggatcgatctggtcggccgatacaaggtgaaataatccatttgcctcatccagctggagaagatattgtggtatgaaaggagtcatctgactgcattgttgatgagattgaacacaagtatccacccatctctggacgagagctaatgtagccgcatccccagttgatgggctgagttcgagactaaagtctcgggttgaggctacagttttgttaatcactcagactgaatgcacgggtaagaagatcaaataccgttgtacaccgtcaaagataggccacctatgtatgtcccagacttgaatatgcccatgataggattatgtttcccaaagtagatagtaaacaaggagaagtatcccataaaagtttgatcaatgtcctggctcccatgctcagacctacaacacaagatgcaaccttgagcaacagaccggttgtaggactctaaagtcaggtggtgaccaaacatgtattgcgatgggtgctgattggcatcacccaacgcagtaggtagagggatgcgagtcctgctgtcatttccaaggaaattctcattaaactctttgatctcgcatactcgcttcgcctgggaggggtcccagatgcccgtgagaccttcacggcagatgttacagagcatagtgaagagtgtttggtatcaagcttcgagaaatctcaggtggaatgcgagtaaaggcatgcaagaaagaccatgcaaaagagttatgacctgaaggaatgggaagtgacactcaagtcagcaggtatttatacggtgactaacttatgctacatggtcgctctagccaggttgagaactggttgttggtagttgttatgcttattgtacctaatgcagcaatggatgcaaggcagaaatctgttgggttgattggccccgccgagtatgtattgttggtgctgacatgcattcgggatgcagaatccagtgaaggctacaaagtgcagagtggttacttctaagtaactaggggtatctctctcctttacataagtccctataaggatcattgctgttgaacacgacttctcgacttcatcagaatggggtcaactcaaaccgggcgtgttcgggggtccttctggcagcagaatgtcttcgtatattgcacctctcgggagtttgtactctaactcaggagtataaaacttactggctgtaaaaaggtttgatgtagcacctagactagatagattgtttgaactttgtgagcagtggttgtatgtatgagtgtaccttatatactaaactataggaaggcaaaacaactcggagaggtggtgtaatggtaataacgctgttagcttgtatagccgtacgcgcagcttattctgctgcgcgtatggctgacccgtctgatagaaatgggggctcgaatcctcctctttccattattttttctgcattttgcgtttttttttgccttcatgaacctgtgtatgcttgaagtacctaggttccatgagaggcggtacagtggctgcctagtacctaggacgctggcgaaagactatattaagacttggatgacccaggccaacaccttaagtgttcaagtttatgcctgaggtcctcgtatagacagcctcaagctatatatctaatattactagagatatagggttaaatcttcttcagctataaattactatatttatatctatagatctatctaaataagtttattttaactcttatactatctaggtagctttcggatactatattttaaataaatcatcatcttcttattccctttatctgtatatttatactagcgatctcctgctcagcattctatatacttaaccctcctccccctctactgccacccctatcgcagccagacaatcgaggaaacagctatacattcatcaacttgacgtttaaatcgtttcagcaagtgcttagtcaagccaagggggaatcgaataaccagatcgcccagtataatggcgactgcaatggtaaataagacggatagacactacaccacgttagttattttaaaccagaagtcaacaacagagagatcaatccagtacctcaagtagtcaaatcagacacgatttgacaggacatcgattatcttatcgatagtatccgaatgaatgcagtttcctaagcgtaatttcatataatttgcaggaatcttagtcaattgttctgaggaagtgcagtacaaagatgggtgatgcttttgtccgatgcggagagatttcaagtctccagtttattagaccaatggcttgctgcgctccgtaataaattaataatgcggtattgctgtccagtttattccgatgagctggaggtctgccaaatttgcaattggctcatgagcaactcgctgtgtataatgggtaccctcttgtcagcttacgatataatgccacccctggaagcaaggcaatattattttcgctcaactacctacatagaaaagcatcacattttcctcaatatatcacgaagaaagctgtaccatcgccatgtctcggacgctcttctccagctcaatttaccaaagtctcaatacaaatacaagcgaaacccgcctcatcgatatcctgccaacgctggacgagagcgggcgggtgcagtgcaaaatccttcatgcctcgttggacagccaggcaattgcgtacacagctctgtcctatgtctggggagatccatcaatcaccagagaaatcatcatcgaagatgctattttcaatgcgactgcaaatctcgcatcagccctgcagtttatgcaggcttcactgccgaggctcccggatgggagctgtttagtatgggccgatgccatttgtatcaaccagacagatgacctggagaagacttttcaagtgagaatgatggacagaatatacaaggaggcaaaggaggtaatagcttggcttgggccaagtagcgatgaagtggaattgggactccagttgctcaacgatataggaggaaacatgaggactgtagaagcctccgagttgatgggccgatatccacagtattgggaggcggcggatccttcacctccagcctataataaatactggaacagcctggatagattcctagaattgccttactggaagcgcagctggactatccaggaaatggttctcccacgcaccctatggttccaggttggagacaaaaccctcggatgggagaccctgaagggaatggttgctctgcagatggcagtaagtcggggtatggttaaaatccccgatccacgctcgaatctcgcggtgcaccttgagatgggctcacaagcctaccttcccctgagactggtcaaccactgtaaggttctgcaacagcagccacttgatgattctcagcaaaacctggtacttttctccgaaactatgggtcagttggccacagacccccgggacaagttattcgctttctatgccctcaatatcagcccgatagtgcccgactatactaaggatgttgggcaaacgtatggcgcagcggcagcttcctggctgagatctggagggctggacccttgtttaaagttctctggtctctgttacggtgatcattcagacttcaagcttgcttcatgggtccctaactgggatacactggctcggccggatgctgctgtagcaaggcagctcaacgacaactttggaaattacgaggccaacaaaggcctcccagaaggagtcacggcggtggacgacgagtttacgttgcacgaggttggagtcatgtatggcactattgactggataggaggcgatcctacagaggcacagcaccaaggcgtgaatggattccagaattatctggtctctacaatggagagcttcacagatgcgattgatcaagcgaagagcgctataccccctttgcagctcattctaagaactatcacgctggacagagtggaaagcacaaaccagataatcgcggggactgaaaagctatacaaagattatggccgcctggaccagctttgccgagcctttctgaatgtcctttcgagaactcccggaaagagtctgactgtcgaaaccatgacaaggactcttaagctatgccaacgatggggctacgatcctcagcaggaggcattagtcaacttttgccggagccaaattttctggggccatgaagttccggaggccataacgaacaggcaataccttgacccgcattacatggaggttgattcaagtgctcaaatgtcgatctatgtaaacgtcagtagagggctgttctgtggtcgtgtctttcgtgcctcggatgggagcgttggtcttggccccttgaatatgctgcctggggatcaactctgcgtcttgagtggctgctcatttccagttctcttgcgcaggatgccatccgaagcggaggaggcttactcttatgttggcccttgctttgtccacggtctgatgtacggcgaggttggggaggcagtagctgctgaagtagcagaactagatgttattgagattcgatagactatgccctagcgagaaaatggagaacatgcgatggaaaggctcggagattttgcctatactggcttgcttttaccttgtatactgatcactgtgagactttgctttcagaacacccaagggaccgaaataaaacatggtatatcgacacttcagcgttgaatttaaacacaatatcaagataattaatttagtactaaatacaatatttagctcaatattatacaataattcatttttctcttgttactgtattgagtaagaaatgaggtccctctgcttacgcaaaaagagctttggttagccatattttatttcacccacctgacagcgtaagaatagtagccctagtgctgatagcactgagtttggaataaagatgaagaacatgctgcaggcttgtcaagttatctattcataggctcgcatgtaggatagtggccgatgtagagtagccgttgctgactccttttacttagccagaggagagttgtattatctatcaaactcctcggtataactattttccgtctctgtgggtcttgggttcatatggcattgtttatttatttcgtctggcgccaacgtttctctactgcataagtcctctactaataaatccctaaagcaagttgaaccccgacatggccgcacatatttacatcgcttgcagggtacatcactctgtgtctttataaatacagcgatgctgacttagttaggaactgtctaccgctgtgccaaacgtagcgtcgaagatgacagaatgctggagcgatattcaaacgccctccaaggcacagtggcaggtcagtccacgactgacaaccacacttgacgaataattctaataggccgatagaatccgcattggacacaatatactcactatttgctgggggatggcatcagcaagaggatattgctgacccatttgttgatagacgaggtaaactgatgatcaataccgtatggatttttgatctcgataacgatctcctccggtttcataaaaaagatcactacaactcagtctccctcagccttctccgtcagcgtcctatttccgcctgtgatttcgagccttacaagccaccaacttctattcaagcctttcgaccccctcgagcatcgcaatgcataatgcggcgtactgggatctgccggatcgcttagagcgacataaggctctggttcagaagatgttggcggactttgcacaccaatggaggcacgttctttctggccgattcaaccactcaacgttcagaaggctcgcttatgctatcatcaagattgtgacgctagattttgaagtgaaagagattgcggcccaacgccaaggaatcggcggcttcttggtctggttgaacaatcttccggagtgggagccattcagtggacatattgtacgagtaggcggggcatctgttgttttatcacagcacccttgccatgcagttcatcttatccgagaagacttccaacaatactgtgtttcaaaaccagaagatgacatgtccgtggtcagcgatcggacttaccttgtattgtctgtaagagaggtcagcctgtatcggatgaattccaggagtgaaaggtgtacggcggccgagcgtttgtttgacggtaccctccctccctcggctgcagccattgatcagcttctgcaagccacgcttagtgtcagccctgtgacaacacttcgaggacttcccaccgagttacaagagaaagtcgtggataatttggcagcaggcccagttgagagagcgagaatgcgttgcatccttgatataggttcaccctttacctggtggagtggaggtcgaggcatagaaagggaagagggccggagaaaccgaacctccacctccccagtggagtcgcacatatgttttgggaagtccttcagtggggtcgcatataagtgatagcttgaggaagtgttctctcagtggctgcggcttggagtaagtctgtgtcgtaataatatattcttagttgttgcttctctttgataattagtttactgggcgttgggacgtttatctactcattccatacattctcaaaaagaccaacaatctcagaagccgttttgttttatatggaattgtagaagcaattcccctatcttctgagtcaaccattctagttgagattgatataatgtaaggctcctcagtacccttatttgacgaggagtcctatgtagaatctatcaggatgaccacatctgtcctgataattgtatctaacgggaaattttagattgatggccatttataaattttgatgtattgcttctctcagttgctaacataaattaaacacttccatctgccttgattccataccctggtccttgaagaatgagctcgtcatttgctcatgtaggtaagattcacctataagcctgtacagatgatcttttaattcttcggaaccttcaaataaccaatcgtccccttcaaagttggtttcttgtcttactgggcgtattacaaagggaagacgagatccaaaaagcgcaataataatgtcaccggaacgtacgtcaggcgggcacagacccatccgctcatcctcagtgataaaaaagcatttacccacgccacggcattgcagtggaaacaattttggttgtgggacgggcctttcaaatagttcgcctttcaagatatcggcaatcctaggcgggggaaatataaaatgaggatcgttctctccccagcacatgcctatgctcgtcgccatagttttgtcactccagggaccatcgggtattgcatcatcttgatggtccaatgagttctcgccgcggtagacagggctcaggagaagagtctccagaaagtctcgaaacatcagctcatcttttccgttgtatctccctccttgcctgcctaaccattcttgggagctgagtgttccgccttcgtcttcgtcgatgatgatagtcggtgattcgcttttactaataattgaccagagaagaggcatgccgcctttaaatacgccacgattgtggggatgagtcaaaaccatagcgggcatcgctcggtctgtcttcatgtctttttctaatacctctgttccccattttttagataggaacgagttctcaacagtagtttgtatacatatcagaggcatttggaaaacggacttgacctttccaatccgtatgccaccaaggcttataagtcggtgagttaggtcttcaggaagtctaatcaccggatgagtagcgagctggaagagacgaacttctctctgtgtagctaggtcaaagtctggttctttcgctaggctgccctgagtccagattcctccacctgtaggccaaacggcccaacatgggtgggatctcgcatcaagatatgactgtgtaggcgattcatgagccctaaatctgaccagatcatctggcaggattcgacgtggcccgctggcaagcagacccaacacatcaagattccccgagtatcgaatgcaccatacggtgaagttggaaaagacttcggtcacagtcttgttgtaatctggagctaggtcttgcctcgatttcgtaccattttgggtctctagggcaaagtcgagtagcgcatagagcttgtcgcgtgggtctgtagcttcaaattccgtataggtatgctcaaagaggttatacagctttcctagcaagctgcatgttttccgattgtgcggcttcttttcgccgttcttctgctgaaaatctctcatatgaagcaattgctttcgcaatattgacccccaggcggtcggaagagtgggtttgccggtaaagtatagagtttcccgcaactgatagcatcgttcagcaacaagtatatagctcaaaggaacctgtgcgttggtgatatggataaaagtcaactgagggttgcatgaggcctcctgaaggacccagatccgtcgaaagtacgggttattgaaaaagcgtcccaggacttggagacagcctccgggacccaagttctcgtttccaaagttgtatccacctgaagatagaaaggtcccaagttgttcgtctgttgggttcaagatatcgaagtcatctccatacctctcagacagcacccttacgaggcccacaatgatgtgtaacccacgcacgacatcttcatcctcgcccatccagatgaatacgagcatagcctgggagtatgtactcctcattatcccaacctggctatttctttcttcaatgtcactttggttgatacatagagcatctacccacagaggctggtagtcaaataaaggaaacctttcctcgatctgagtcttcgactttcggaggctctttagagcttgatagagcgactctgttacattaaatgttttcttagtagtcacattgacagcaacgagctggactccgtcttcaggctcttggacgatgctatcatccggttgttcgaaactgtggtggacgagactgatgctacgctgccgcgccatatctccccagcagtacgataaagcgatgtacgcaatccgaccagttttggcgattgggtcgctcaacacgcagacaagctcctcatcgtcattgtcaacgtcctttggaggcagtacctgtaacagccgaatattttctttaccagactcggtgcttagtgacttatacgacgaatagtcgtttgtaattcgcctctttgtgatctcagctccgtcttcgatatctgcaggtttcttctttgtcatttgcatcgcgctctgaccgagttcctcagatccaggctgacgtttagcctgaggttccaataaaagttcatccatggaagatgccgtcgtcaatcaatctacaccgtaccaaagtgaaaataagtttattatgggaggatgaacgagtgatgaatgtactcatgggttagtggagaacatttgagggagagtcagcgtggttttattcgattgctgacagcttttctgctccgcatccgcgcttttgccactgattatgacgcgtctcaggcatttgaaacgtgtagcctgtcgtattaatagtaaacgaggcagccgtaaggcggacacatacaaatatctcccagcaacttgcctaataaaactattccaagtttacccttaagaaaaggaatttaggctctctgtaaaacaaaagattccattaaaatgttcacatgtaaaaaaaaaaaaaaatgtacgaaaaatcgccatattgaaacaccacagaccttgagcttatttgatttattttgttgccccggagctatcatcctatctgggatgctctgtatataattacttcaaatttaaggccttgattgagttttgaattagtctgtaagcgggatatgaccatggaaagcttttcctcgccaagtctaaagctgtaatgccacccttttttgcaatccgtggatctgcgccatgctctattacgcattccacggtggtaaagtagtgctcgctgactactattgggggtgatagaagtaccagtaaaggtgtttctccctcggagttttgagcattgatgtctagacccagaaacagtagcttttctattgattctctcatagattccttcgatgacgaccaacgctgcttgaggcgcaacatatgatgcagtatgttggacccgtccgaaaacacgatgagaggattggccccgtgatcggcaaggtgccagagcgtgcggtcctccatcggcacttgaagtaagttggtcgtgtcatgaggcacaagcccagaagacacgcagtgaattactatgtcgtcatacaggccattgctccattttagcagatatgagagaaggtctgacttgttaaattggataagatggcggcgacgctgaatgataagagccaagataggatgtggcgagcatcctttggatagcaatggaaatgaacgtgctaaaacactcgcaataccctcaaatggctgggtgaggggatctggctcatccccgaggaacctatacctgtcgaccttaaccaacttctgttcaggatcaatgcagaagcatccgcttccaagtaagaagagcgcaacgctttgataggggtccaatcgatatcgggtgttgtagaatccaagcagaaacttcacaacctccttctgcctttgatcaactgccatatgcagtgcaagaaggccgtcttcgttttcgacttttgcttccacactgagtcctttaacgatgagtgtttcaactaatggaagatggcctcccagtgctgcgaggtggagcatgttgagacctttttctgtcacttggaaaggatctgctccgcgtagaattagttcatgtgcaaggtcaaaattgccaaacgaggccgctatcagagcgggtgtcccttctggggcgttcgcgtcgaagtggccagacgtatcaaaagagcaaagctcccgagtaatcaagatgtcaccaaggtaggccgcaacgtgaaacgccgatcttccctggtgaattttgaaaggcgaatccccgcgcaacaggaaatatgacttgatacagtccagatggcgtgctagcacagtaagctggagattctcacacgaccttctgttgatcccacgatcgttttcctggcaggaagggcacagaagctcttcaccaagtccctccttcgggggatgacatatgacccaagccgccataggagaagcgaatattggaggagattgactccctcttgtggctgaagccgacataggagaagttaatgttggagaatattgactccttcctgggggcgagtatcgtctcttcctctgcactgggaaaggcgctttcaatttctggagaagctcgatcatctccgggttatcatccaagtcaattatatctgccgtggtcctgttgaagaaatcacgtcggtataggtttgcgcgccgggagtgtagcagcgctgcgaatgcaacatggccttgccggactgcatgaaacaccggggtgaagccaatgcaatctctcagttcgatattggctcctgcgcccagaagcaccttgcctatcatcgtgtttccgtaaattgctgcatagtgtagaggtgtccgtcgatctttgtcccggacgtcgataataggccgtttctccgtaatgaatttggctaaaactggaggccattcccaagttgcaatataatggagaagtgagagcccttgcttgtctcttccaaactcgcgtgttggactaagtagcatcagctctaggattgcttttgcacccgagttggcagcgacgtgcactggagtccgcccatgtttatcgcggatgagaatgttagctccctctttgagcaagaattcgatagcccgtaagtttcgatgttcagctgctagatgcaaaggggtactgccgtcaaagtcttgaacgttgatcaaaccccgttgaactttggaaatgttcgactcagcgtagctccaacccgagaacgccgcccagtgcaggaccgtccgtcctcgtgtgtcctgttcctggctttctagtccaaaactgattcgaaggcgctcaagcataccagcccagtcttgttgtgcacaaaggttcatcaggttgaatcggccttcgttgctgaggcgtacaacatcggcccgggtacagacgaaagtaattcctccagttcttgctgatttccaaagtacgccgctctagtaagcatgttcattccatcttggccaagagtaaacatctgggaccgatctctagagactaagattttgcgcacctccgtccacccctgaagactggcgagggctagagcgtttgttccgttgccatcagtcgtagagacatcgagcttctcccccaggctacggttcagaagctgcattgtagcctgatacccatcccctctgccaagggcatatatcaaaggtgataccctatcgacatctagagcatttacatcaaggtctgccctttccagcaggggagggagtagatgcacaagtggttggccgtgagaaatgatactgtgcagcacggtacggtctctcatccctttgcagttgatgtctacctttggggacgaaataagtagtagaaacgccttttcatcttcgattgagaggtggagtggcttgctcctatcggcgagacctatattgggatcgactttgggattgagaagtaggaacttcatgagctgagatcgacttttcctgaccgcccaggctagcggagtgtaccctgatctatcgatcttgttcaaatctccatcaaaagccttgaatatttctaggaaatctcccaactggaccagaagatgcattggagggcagtcgatctctaggtccggttgcagacgaagtccatggtttcgaaattcaagttcgagttttgaatagagttggtagaaaactttgagattttcttccgtaaagaaaccggccgcggattgaatgacttcaggctcatcttggaccttttctaaatggctgttaaaattctcaatagcgtatagcaacaaaggcagttgtggtatatcagcggagagaaattggctgtcctggagaactttttggtctcgcttgaaaactacgatctcaccgctgtgtttcttccagtccatgaaggtgagaactttgaagcagacccaattcgcaaaatactcgcagcccagaattgaggagcgaaattgcctgataagctcttcatccatagtatccatcctcttctgcgtcaaaaactctcggaaagaatgatgccggaattgcacggagcctactgaatcaaccgataagaagggcgtgctgaatcttcgtagcacccgctcgaaattgaaaccaaagttgctctggacctgttcgtaaggccgatgttcttcacttatagagacggcaaaatgaatgtcgttgatagatagtggccttcgagcaactgtgagaagcataaatattttcttcaaaactggccggaaatctttgggtacgttggaaagaagacttgcgtagaggtgtccgaggttgaattcgagttcatcgagttcacgtagcctggccttcaccgtagatgggctccaaagtgatacgccctcatagaaggcggtccaactcagagaggcgatgagaaagttggtgttagaccgagctgttatgcctgcttgtatttcaggcaacacatgtgaggggatagaatgctcttgcccgaactgcgtgactttttgttcaatgtattgttgcacaatctcatgcatcttctctgagtcgagacataaagagttcgcgatatgggcaaactgtgaggcaatacctgatcggttagaaatgagaatatggatgcgtctgctaatgtcattgacagatattctccagatggaattcagtaaatcctctgctgcgcctacgggaagctcgtcgacggcatcaataattaaccaaaaccgagtgttgcttgcccacagcataacatcggatatatttgatgtcaattcctgactcgttaatttgacaatatcagctttgtccatcttgtttcccaaatgtttaataagactcggttgtgcctggagaatttgggacaggatagacctcaaaataagacaagcagcagtctcatctagagtcactttcccatcacagaatatgtaggaaacaacatccgaaacattagtggcttgttctttttccggtcgttgtcgtaagaggtcgatgacatatttgactagaacagacttgcctgaccctggagagctatgaatccaaagctaagagcttgtgtgagcatcaaactagttgaggaatgtagcatcctgcttgatccaatcacaagtccctggggcggtatcaggggtagcatggtacttcatcacagggtcaaaagctccattactcggattcagttcttggagaagtttcgtatagttcattggcgacgagtctatgttatcccacatgttagcagttcaaaacatatcgctgatcatataacatctaccatagattcgatactatagtcttttttcattaataatttagaatatctcgacttactctgttgggcggattgttcagatgcacactgatcaaccaactcttccaggcagctcaagaccagcgtgtatccaggatcactcgatgttaaaaatttgcaaatgtttcgatggtcggcctctaaaggcagaggaacttcgttcggaagtcggaggattgcagaatctgactcaacaacctaaataaataataaggaatctaacaaaacccgcatgtttggagaaggatagaccatactagagacttgatgtgcttcgtcttgactctttcgtagaaagtaaaaatttggaggccgacggttctttggagaaactgatcctcgatgtctttaagaactcgcgactgcggttccaaatcgttaagcaaaccaatgcggacagaatctgaaataaagagattggaaactttgccaagcatcttcgcccaagtggctatatctgatccccgatggggtgtgccgagaaatatgaccgacttgatttgagacaggaggctcccgtatcttgactcatgatcatgagccaggcataagctctggtgcatataaaataagtattaagaaatgaagagagagttgcatagtttcctcacctttttaaaaataattccacctaagctatggcatatgaagatgagcggtcgctgcaacatccttaactctctaaactcgctaagatacgaagggtctgtcatcactagcttacgtggtcgggaaggtttcttcggacactgagaagacgctctagtagttctcttgcgaaatcaccgatctcagaaaccgttttggcaaaagtagtcttggatgagtagccgaaggtgaatatgcgagcttccgggatggtggaggggagaaagtcacgaagccagacacttttaccgcttctccaggtctttattgggtggccaccaagtccatggatggcgactatactgttggaagggtaaatcatgaatttagaatttggttatttgcttgaatgtctgagagcaggggtggatatactcaaggatagtctggacggcgacatcggatttgggccaaagttggatcagcccaatgtcgccgggggttagagcctccatgtctgccaacagtatcgggctacaaacaatgcgactttgttcatgaatgagggatatccaattcctaattctcaggtgaggggaactgactacatgtaggtaagaggagcatatactgtcttatccaattgcatttcgatattgtgaccaggattatgcagctgacggaagagacttataggcccatagagacagcaatccccattcgccactccccaaaaagcagtagagaaacaggcctaatatcaaaaaatttactcgcattcatccttggagacgatggattggactggcaggtggcgaatgcgccgttttgtcataccacaccattttgggatttagccaaaactatcaactcataaaataataaatacaaaatcagatgagacagattgtggatggacgtataaatctagaagatgtcgcgaagtgtctcgacaaatcgcaccgatgcctcggtaatcattcttgaggtaactgaccctatagagtcacgcaaatatgtctccggtgataccatgatgaaatttttcaacgacaaggggatcaagaaaagacacagatcagttgatgccagctcaactaagataataggataatcgctcagtttcaaggaatacattgaaaattttgttataagtattctagacaataacaagccgagaaatccctttctccctcttgcagggcttggtgtgggttgtcaatgcgcgtttcatcaaaatacctaccttgttgggaagaggggcaggcttagaggtcctaagcaagcaaagtgaaatcagtgcatgggctcaaaagcaaacacgtacatttggaaaatggtagttaatatgtgacgatactagaacgccctctttacagtagcttggagctcataactgctacgagttgatattctaggacctgcgcgcttgggctacacgcttcgagagacctacgaacccatctttcaaagaataaaaggaagagttaaagaagattactagttctatcccatagcctgccaatcacaagcatggtccggcaaacgatcgggacaattggtgccgtcaatgccgattgtaacagttctctaacatcatctaaattgtgtaacagtctactagatgatgaaacttggcgcttaggcagtagctggtctacagctgcactccatcctcgctccatttgtcatggcgtggtgaatgtcaatggtatttcctcctgcatctcggctattgtgacccgagagtgacgatgccagcgcagatcatgatatccggggaggattacggacttcggcacccatcacatatgggtttcaaatggcccaacataaacaaacacgggccatcaatgctcatgtttatgcctagggcgcttggccagaagatcagaggcttccacccttgcgatgcgaagccagaaaggggccccatcgctcactccacggtgtgccctgatctcaaacgcaggcatgtatgatccactcagcacacaattctcgtattgtacatcgagacgacgagggcattctgagcatgatgtagtgccgaaactgctacattcgaagttgagtggagtaatcactggctcctcgaagataaatacgctggaccaaggcgtaccagacattcgtttctgatccagactcacctccttgctaagataccaaccagagaattattccttcattcatttttagcagaccggatccgctattttttgttctagaacagctttccttcatttctggtgactccagaccacatcgactatctttttcactattgatagagcaaccgcaacaaaccgtcaatatgcatgcctatgctcttctcgcgctcgttcctctggctatagccgctcccccttcttccttccacaagcgtgagcagatagctcctcttgtggttccccttggtggcaaccacatccaggacaaatacattgttcgcatgaaaaaggatacggtttcatcttctgttacttctgctctcagctccattaaggccaaatccgattttgtgtatgcccacagctttaatggattcgcggctaccttggacgatgaagaccttgcaaccattcgcaagaatcccatggtaagtatagatcatgtttgttttttggtctctctctcccaactgacggttatccaggttgactacgtagagaaggatcaaactatctatgtttctacgacgcaacaaaatgctccatgggggatttcacgcctttcttctaaaactcccggtagtaccacttacaattacgacccatccgctggtgagggcacttgtgtctacgttcttgacaccggtattgctattgcccatcccgaattcgagggtcgtgctacttgggccgccaacttcgccggtgatggtcagaaagtcgacggtgtcggtcacggtacccattgtgctggcacgattggctcaaaaacctacggagtagccaagaagactcagctcttcgctgtcaaggtcctcggcaatgacggatctggcactaactcgggcgtgctcgctggtatggagtgggttgtcaaaaacgccaataagtccaagtgccccaagggtatcgtcgcaagcatgtctcttggtggtggcttttcccaagctatgaatgatgccgccgccgctatcgtcgatgccggaatcttccttgctgttgcggccgggaatgatgctgccaacgccgctcagacttctcctgcttccgagcccaaagtctgcactgttggtgcctctgatgtgaatgaccgtattgccgaattctccaacttcggcaaagtcgttgatatctttgctcctggtgttgggattctatccaccatacctggaggccgtaccgagaagatgtcgggcacttcaatggccactcctcatattgcaggccttgctgcctacctcctcggtacgggccagaaggttgcaggtctgtgcgattatatcaaacagactggcgttcaaaccttgtccggtggccccaacggcacgaccaggaccattgccaacaacggttattccggtaacagccagcggtcatactttaacctgatgtaattgccctcgctcgttgctagaatgagccacgccgcggaacgcgatcagaaagtctttgcggcttcttgtaaggtttgtaggaatatttcctttcgcttttggtatcagttgccaatattggaaagggaggaaaggaaaaaaacatgagttcaaataactaagaagaggctccatgaattatatcaagccagcttctttcacaatattttagatgggtagctacaatctagcgaacagttttatcaaaccagaattctaaagccattgtcttgattgcatttaaaattaatgtaggggtttattatgtgaaattcaaatccaaaagtcctactgacgtctggttttgttgcaaccttccccacacgttgatatagatcaatactcgattccggcgcatggagaataactaccatgattccatactcgtttgtatgataattgacactgtaaaagaagaagaaaaggacaagttagacacagcacaagcaattggatgcctagttagacatacaatcaagggccaagcctcgccttttagccagtgagaaaccacgtcaaagtcttagtgtgcaagtatgtaacaaaaagataccatgcatatgtcacgtttctaagacgaacatagtaggttttcagtgagaggggtaagccgacttaaaagacatatttcaacccaggggggttcgacgcgacctccaaacttacgagggcttaaatatgacctctggttcaccttgaatgttctggctaatcgtacatagcaatctggctatgctaaatctagtatttctgctactccctggtgactacctaaagaaaacgatgagctgatcgttttgccttcggataatcctgaagctcaacacgcgtaaagagctatagatcgcgccatggtaacctccatcactgaacacacagtctcgcctaaggtcaagagcgtcatcacgcctagaagcgcctcaagatgattctgagaatttctgcgccgtattttgcgaggttctctctcactcgtctcatggcttgtgtttgtaatgtggtgattgggtacgatgtaacttgtaagaccaagatatgtacctggaggtggacgtggcgggaattgaaagggtggagatacacgaggcactggaatgagcagcgctttagttctcagagtgttttcgtattcctcatcacgtcactgatgccatgacaattcaatggtacctacaaccacaattcagaattaacatcaaccatacgactaagcctgtgtggtaataaaaacacaattggatagcgaagtcattctgtagtcgcgatgcaagctatcattggcattaatccatcgcaatcctcttcagctgaagtggattccttgcaatgtccgcattcgcagtgacattgtcagataagtgttgatgaccaattgaggttgcccgtgggctatcagtacatgcattacccctgaaacgatcagcaatcagtgacaattctggaagctgtgtagttgatatttgaatgccagcatcctgtaacaaatatcacgtaattagccacagcccacagagagggcccctgcaggccttagagcatacgtgtgtgtgctctgttgacttcggtgcctgtatgaagtaaaataatatggctagagctttccgccttcatcgtttggtactcggggttcacctgaggcaattgaattatggcgcctcgctttctaagcctcctccgccacgccggagctgaggagtagaggcatgcacggtgacatttgacaatcaaaagaacctgcggactatttcatgtttgacgttttgaccgctgacccttgccggcacccgtgaattggctgatgaggcacatctcgacctgctgaggcccgctgccgatcgccgagataatggcttagcatggtctagtaacccacgacctgccggatttgtgtttgccgatcgtcctccttgattcacatggcttcgaaacagccctttcactggatggcttaatgttagtggagatcgcgtggaggccaatgcacgggcattgaggtgatactaacctggaacttgctgaccttttggatcatcatggccttttgttgtggtattaatggggctgacacggggactgctttacttataaggaagcgggtgtctcatctcattcacagtgctcagccaacccagcccgcctctctagtctctcatttcaggtcttgaatctcaagtagtgttcaacatgcagttctctctcgccgcccttctctccctggctgtcgccgtcagcgccgctccccacactcgcgctggagaggctgccacctgtggcaacaacgactactctgccagccaagtctctgccgctgctgacgctgcttgtcaatattaccaggacggcacaactgccggtagctctagttatcctcaccgctacaacaactatgagggctttgagttcaagggcttgagcggtccattccaggagttccccatcaagacaagcggagtctatactggcggttagtgctcccatttgagttttcctctcttgaattcatacccattgctaacatttttattctatggttaggctcccccggtgctgaccgtgtcgttatcactgaggattgccagtttgccggcgccatcacacacactggtgccagcggcaacaactttgttgcttgtgatggtacttcctaagcaacccttttgaccaacgcattgactggaactggtttgggaagataaattatgagtgatttgtatatatgatactatcgatacgagtgatgcgtatatagagcagctaaatattcatcaaaatagccgtacaaggcattcagttacactctggttaccaaaccgactgttttgtcacttgattgtctatttgatctctacaccgctggttacttcaatgcataccttcagggctagagatctaagggttatcagatcactagctcaatttaatctggggagaaacagggagtagccaggatgcctccaacaggtaatacaatcgccaattcgacaacatattcccacataatttataatattcaaaagatcaacaccatacaaagcagcatatctaggcaatagatatcgtgataagatgttgttgactcattattgtggcctttgttgtggtttgtctttaggcgttcagttccttgatgtacctacctcagataacttattggtctctttgaaatcattccccaggtgctgccattcagtgcaggtcagtcaaataacatcactcttcctgaagtatccaacatattgtgatgggatgtatcgacataaagcttgaatagttctatgctaagctttcagtgtagtgatctgctgtgagcgagacgagcacctctatttctctttctgattgtcatgacaattcggtttcatacgaagtgatctctgttttgaaactgagttctggtgaaatgttttattcgctccgcctttgaatagatataaactaagcggcatggtaatccgcattatgcgttaagaacagtgtgtgagttttctatgtgtaagatctaactattttacacaagttcatcctagcatttcaagtaggccctgtgtcattagtatgcacagcaccttgatccatcttctcatcgcctctactgtcgtgagcctttctacatagagttggagcatagcatcgcaggcgggtagctttgaatttggcacactctgggagataccagctctaattcctccacattctgaaagttaagtggaacgccacttctatccactgttagataatgagttgtttgtcttgtctttcgacatagaagtgctcattaagacgatgaacagccgctgcgggatccggaggagagagctctttaaggtcgtccagatcccctgctagactcttatcattgcgagtcacatcacgttcaattagagtctaatgactttcgccatggaagaaacatgatccaactttcagcatcaccaacccgcctgtcgggtataagaccgctcggcactacattgtcgaaatataatatggcgatagcttagtaaagtgaagatgagtaagtgctgtattccggtaacctagtagctaagttgccattgcaagcttgtgtcctctctaatgacaagttagctctcgaaccttccaaaatccctactttcatgacgaatattatactcagaatcgcaaaaatagtttttttttaacaggatccttgataaaaagctacgtaatagcggaaacaaaagtctagattcattttcttttaacatctgcgcctagtttacattcggtgatgttagctgttagtttgctcttccttgtctccggcttggtttttctagggcgcagaggcatgcggctgagaaaggtaatccttaattttattatatgacaattcacatataactataagcagtaattaactcgttctagctattgagctatagctacagttctatctaactcatccctattacattaatcttacacaacatgtatttgcaagcttccctcagcataagttgttgttctcttcactcaagctccgttatcagagacctgatggatgatcattcgggtgaccacttgataaattattgattttcattctactgcccgtatgtagcatttttaccaatggcctctcctaagacacgtggcaatgggatactggtgtggcgtcaaataaaatccctattcgtattgataagtaagaaggtctaaccgaatgtaaccaaagcgcccttttcttcgcttttcctattacatgcttttggatggtcagcttcgtgcaacctatacggattgccatacgcagtgcttatcttccacgcgggagaaagatcagcatcctcattttctagcccaagtgctttccacgtcagctatacatcactatccttcccagatcactagaatttgactcctataaagaaccgtatataaattcgggataggtccagtaaaagaaatggcaaagatatgacgccccttggcctttgcccccaagatgcagctgacgtgctgacttgctgacgtcggatgggtaggattggtacgtggaacacagccgctcgggtccggtatagcaagtttccccgcaaacctggtagacgaataaatacctctgcatgtactggttgctagagaatgatccccgctggtttccttcctctccttggtttcccgagcaaaaacgaacgtcattcaatccccagtcccatgatggtatcatccgtaacgccagaaaaccccgatttatacaatgtcagcaacatcgacggtacgaagctagacacggtcggtgtatgctgggcttttacaggcctggccgctggttttctcattactcgaatcattgcgagggtgaggtgggacaaggagatgtttggccatgacttctggtgcattggaggacttgtacgaaccagattttgcttataaacccctcttgcgagtattgtctttaacattatcttttcccgagctagacatgttccataatctcgtgcgctttcctccagattgccatgaacagcattgatggagaagcctttccatatgctactgcgcagcaatggagagacgccaagttttggcagctcatgtccctctgtgtaggggctctgtccgcttcgctgcctaaactggcaatcgcaacattcctcgtacgacttttgcgtccttcgctttggaaccagcggttcatgttgtggatggccatctggtctctcctctcccagtccaccttgagcatcgcgatgatgttccaatgcagtcctgtggaaagcttgtggcaacccaatcaacaatccagcgattgttcaatttcgatggcaagatcattgtccgcttttagcatatactgccaaggcatgtggattcgaactagactaccttacctatgcagagtgatataccctaaccaagagtgcatctagtgttttccgctttcgttgatatttatctctccatctatcccgctattataattttccaactcaaaatgaagctccgacaaagaattggcctttccatcacgcttggcatagggttatggtattatctcacttctagccatgtataaagtgaagaaagactgacagatcgggtttgcacagctctgctgcggtcgctatctatcgcattacagttgccgccagaaggaactcttcatatgccgttttcccatgttagtatcaatactggtactatcctctatttcaaccagatacatgctaactgtcaatagtattcataactgagttgatcaaatggacgacgtgagtacttaaccctttccttcgctatcctatttctaacgcttcttttccgtcgaagaatcgaggggaccaccatcacgatagcgtgttccatccctgtcttgtcgccactttttgaagtattctattcctggtcctctagtttgtcatctatactgtcgtcaaagcttcgatcgagcggtggcgcggaggcctatgcattggagtcttccacggcacgcagcagcaccctacccccgctatctccacccttacagaagcaacatagatattcgcgcaatgaaagttcgctctggacaggaaaaactacgcttcagtcttcgggggcctctcaggaaaggatcattagtgaagaaagttgctaataggtggtgttactctcatgaagccggatcctacactaatacaccccataattttacagtatggcgagaaaatttagtaattatccaagtcttttgtatatgtgaactttcgtctattcataaactgttaccaccaaggccggtgtgcctgcaccttgcgtgaatcatatgattttacatttccgttgcttgtgataagacagatgttatattttgcagatcctctcttggccatatcctgcttatcctacagggttggggcaagtcagtaaatatcttggtcttaagatgccaattatgagaaggtatgctctatgacgcggcccagtctggattgcagctctactagcagagctatttcgtcaatagcgtgttgctttcaagtcatgaccagcaatgaacaacagggtaatcgctagtggcatttcgttctgacaatgtaaagtccctatcttatcccttatcaatctgcatgcaccaaacgacatcgtctgctaacctgggtcctttagggggctcaacgccttcacgaacaaacgtggtgggttcgggagactgatgacggggcggcttaggagtacccttcaaaggcctcttctcagacttctccggttgggggacgcaatgcgcggctgtgttgttgctgaatggggtgggcgatcacggtaatcgccaggcggtattttatcggctccctgttgtgtacttacgggctagctacattttgtccttcgggcacagtcaaggggggcaagacaagccgagggcatggccagctctcgtctgtgaaggctgaggagggtgcggtgatgacaaagccattgtaacctgcatactatcagggtaaggtcacgcatccttgcagaccctgaggcaatttcaccttggtctgggtattgaggatgcatgatgcctttcttcgaaatatgggctaaccatgtttctttcttttaactcaaaattcaataacccgaaaaccaagcacaagttatatatacgtgatactattctgaacactgtagttactgatctgtacgggtttcgttgcatagactttacgacggaggagttggatctagggtaggtgaagccttcgcatggctcgacgaggatgaagaagtgtcgaagaggatatagactgaacagtctctgtccgagttagtgggatggatttcgtaaaattaggcagtaagtttctataagcaacggtgttagctcaagtatatcactaatatataaagctttgaacaggaacaggttggcaacctcctcatcccatgaagcctgtgtttagttacatgcacttccgtggccaacatcctggaatcggtatgtctaggggagatccaaagtaggctttcaaaaccaagagataaagacgaacgaaacgcaatcttggtaactcatactgggagtaggtggacaccatttacaaccagcagtggtctttcgtgggcgaggacacggaacatcgagatgatctgacaaccgggagctcaagtgtaaagagtagggggcatatagccaggaacaagaatatatgatattcgtgggcgagtaaaggtaaccgatttcgcatgaatctcgtccagcaaagtcgggattgctgatgctagatttgatagctcggattagatatggcaagcagccttacttaatttgaaaagtattgactgaactctgagaatctctgccaggtggtcttagggttagccgaggttgggcttcatttgtctcattacctcaacatgtagtatggaagcttggcgcaatacccacgccgtcacgcgaatgtacctgccaacggtaaagaacgagacaggtgaacttcgccgtgaacgttttagacttggaaataacatgagagaaaatacatctcaaagttactcctcttaaccaagatgttgtaagttgcggtgagcccgaaatattgggctaagtcagcgagtcatttccggtagtgtatgatctcagcctcttggtttgcccatcctcaggatcggtgcctcggttaacggtttcatttccacgccatcaacttgcttagccgaagtcaaacgctgtgacgcccacgtttatgcgagagcggttatgacaagaccggacttatggcggtcgataggatatagcgtttccaggatcaccggtgcatatcgtgtactctaccccgtatttccatatttctggggtaaagtttcagctcatttttggggcccatcttgataccctattgcttgatcaggttgcattggtcgtcacgtggcggcctggaatgttgaggccgctcgaagagagtgtcagtggggagacaagaatcgatagtctagctgatatcacatcgctatggaattggttgccgtgtgatcatacgttatcttatgtttcgatatcaataacctgatagatgtcgtgatttatcttgaagccaaacatatgtgtggacagggcctcggcaggccttcttggctggcaatatgcggaatcacatgaattcccataaggaaaagaaaaggatgggaaactggtcaatactatactcgacaccatttccattattacgaaagtggaaacagacaataagagtcatcaaatcgaaccacttctgcagggccatcgaacgacgaacgagtggcaagcctcgttcgaacgagagaagaggacacagagcttgcaacggttacgctcctacggctggaagggagtccggctaacggacaacagggaaatcagaccagattgccgtgaaatgggggcaaagagggcatacgattacccgaatgaaggatgcgaggggcattctctgaatcattacggtaggggtttctgtggacttggctgcgtataccagaaacgagcgggattgttggagtacatacgttggggttcgggagtgtgacaccctcctctcttacgtctgttactgcccgcgcgcccagcaattcatgtaacaagggggcctagtcagttggggtgctggttagccaaaattcatgccggtctacggagcactctatctttttttttgcatttcgttctactgctcactaatggcgaggaggcggcccaaacacgcccgtggaaccagcttatttgctagactataccggaatgctcgtagctgaaaacctgtgcgacaaaataaagccgggctagacattattcccctttgacggtgggggaatcaagaggcgtccagagcagctcgccatctagcccccacaagttccctgacggcgccttgtatgctgggtaaacaattccttccttctttcttctatttggagaagctgttgcatctgtagctcctcacgaggtgcctggcttctcttctggggttccccatgtcctccacggccaacatacatacccttgaggtgcgcactaagcatatcatgggatcacagacattcaaacttaatgcaggtacacgagggacatgtcgagaatggccaagaaggatggcagtcggtagagacatgtcttgtcctccatcggccacaaaggcttgccttacctgagctcgccttgcgcaacaccccgagggcggtctgtacgctgaagtgccttcaggcaggtctgagggcttgcgtaagggaatttgtgattggctgggggccacccacccacctattcctcgtctgtcctctcactctcacacgcccctcctctaccctcgaccaccccggcctcaagtgcaaggggggggaaagaggagcggggagggggcaggaatggatcctggctcacctccagtcaaaagactgatcaacggcaattctttccgtctgggagtaagcgcgtgcgcatgtgtgacgctagtatctcaggatgatcaagaagatcaatgcggacaacgagctgtgaggggactgggtaaactaagaaggaagggggcctgcacacaagttccaatctctagaatagcagatggctaaggcgctaggtttcgggaacgggctgagaacattctctgcgcgctgccaagtgtgaaaccccgggggctcgtagttcgggtcggatctctcagtggctccctctcatctcacgcaagcgacccgaggcaagattcctctgtatctcctatttccccagaaaagagatgagatggtagattggatccacgtggcccatctcgtcaggccaagattaggcaaaatggcatgattttcgtgtggtgctcagatggggcggaaacgctggaacaggcaaacaggtagagtgatttgtggtgcctaccctcatcccatatttttgccatgttgtatcccttttgggaatcggggagtagggccagagaggtacattacgattgtgcatgcttacattatacaaattgcgatagtgtttgtccgtatgtagccagagataggcaacattcaaggagggtgggaattggtcgtcgtggcgaaaaaggaagggccacagaagatgtgagggaatgattctagccaacatggattttttttcgcgctaggctgaacggcatcggtaatgcaaaaagccaaattttgttgctgccgagggaagtgaggagaagggtaatatccagacaccccaaaagttgggggaacgacgtgtgggagcaggagagggcgaatgcgagagtgtgtgagggagcaacagagtcagacggcaagggaggggacacccatctccaacagcttctgactcctgagatcggcccctgttcattttagtactagggccgacagcggagggaggagaatgtggtaggtggtttgcggtgtacgcgcagcccaagatgctgcatcatgtcctcgagggtggcgggttggaccagggacccaacctgcctgtctggtgcgccgtttgctggctactgtgacttagtcgagtttcccctctccgactaccctcgctagccccctgccggcgccctggtccccacacagggtcccatgtgattcttggggcaaaacaagttgaggcccaggtgccggtcatgtgacaatggggaccagagtgaggggaagaaggcctcgccagacagtcgagtcagggaggcaaacgacgggggcaaggaagcgcttttgcgcagtcacaggcctcgccgtggtggattcagtggagcgctggggaagcttatacagtgcaagcttatctgcatccttatccctaaaaattggggggagaaggcgagagcgccggctaattccagcatgaaaacgcggagagcagctagatccgaccccgcgttttccccagctcaggagcaggaccctctggagctggagattgtgctggagcaaatctcgacacggcgcatatgtacgcaagtccccgtttttcttggggggcgctgctcctcccatctccacctgcaatggcgaggtaggtttttcgttctcgcattgttgcgctcgctgtgcggaatgacctacttcagcccgcccatggcaacatgccacgcgaagcgcgcaatctgctccgccaggcacatgggcggaatgtaatgccacaagaccgcgagtcttggttctgcaggttgctcgcatggactggacggcgcccttaccagaagggaaatgcattagacctagaaaacagaacatgccgagcggcctatccccatgtggctgtgatgggcgagtcgcagcacctttggtgccaaatcgtaagatcgatgaaaccccccgacagcactaagggtctggcaagtctggtcatcaacaccgtgtgcgcgcaatggcccagcacacagcccatcgctgtggtgcctggtgtgagtgaggcgaggcatgtatgtatgacagcaggtatgcagtcagggaggcctggagcccaacgcccaaagcctgaaggaggggctgagagacagactggactggcctggacggacagcagcgtcaggctcggatccgttggctgcatagtgggtttcagcgccctctccacagcatttgatacagcgccttggcacaaggcttagggcgcgcgctcgccgcaagctcttcgctaactgactccctattttgccgtcgcctttcggccaaagatgctgtccgctgccggtctggtctcgaagcgatcagagcttgcttgggcttgggcgcgagcaaggatgtggcaaggatctgaccagggtgtgccatgacccaaagtgccagaggaaaggcagccagtggcagcgcgtccaattagcaagtcccctggtggaggcatccagttccatccagattgaagagtaacattgcagcagactccacacgtcccacgtccagttcagttgtggttgcctcctttcctttcctttctcacgtccatctcgtcctgcttacctgctgcatcctttgtgcttgcgtacctgagtctggctgactcgctgttggcccgtctccaacgcccattttaatgcgccttagcttccagtagcccgagctgggcgatacgagcgcgcgcagggccaagatgtgtcaactcaaatgggaaggattcgccctggcttggcttcggggccaatggcggaatggggatttccgagccaccagccatggcatggatcattatggtcggtctcctccgctagcctcctcctcaccaagccaacaaagagggggactgaccgggggagtgagcgttgagacgtggcagctcatcaacattttcccatcatcgcacgtcatgactcttggtctttatctcgcatctgcaaacagtcagagttcgggctaatacacgctcatcatgacataagaattagactagctggcttgtgatgccgctccatcacattttggcgcctagtattagccggccctgtaattaatatccgtaccacatcacgaaaaagaaaaacagaggagacaagagctgactattgtctcacccaatggcccgaattcccattgtgagtggcttgacgcttgggggaaaatctcacaaaactaaatgagatgtcttatcgtgcgacctgtggctgcagcaggttgcatgccggtctttccgatgagaaaaagcacagtcagtcacacacgggaaaagatcctaggtgggtagtatcaaggtcagctctcgccctgccctgtttgaccttactggtcattgtcagggtatcacagatgttggccgggggtggacatggaaggacacaggctactctggattccgctcccatttccgtgatcaatttaacccgccggttgagctgaatcgaatattatccattaattcattattggcccgacccattaaaaaagatcctgcgtatgcgatgtatgctggggccccgacttttcttttcacgtcgccttccccaggcaggcaaccaacagcccccggccccctcccatctcatcccccacatccatctacttccattatccatattctctcactcgcccgttcccagcatgggatgagcaagggattgtcagaagacgcatgtagattcggagatacggagcggagatgcacacagaaactggcggaggttgctgcaggcctgccttgtacgtaacacaacttacatgatgcgcacgtttcttttccttcgctttgacttggctcaacgtaacactatctactttggtttggagtgtctctcctcattgtgcttcaacctaggaggcgccggtgaggcccctcacatgcaggactagctggtattagtccgactctgctgtgagaggttctagaattgcttgctcgctggttggtggaagtgatggaatgcagcacgcctctggcggtattctcaggacagtctccaacgggacccatgtccctaatcccaatctaatgcttgcaggggtctggttgttcgtatctccatccagctccccatcttccctcattactctttcagcctgcggggaagatgccgctccctgtctttcgcctccattcattagtttcaattcctaatacatggcgtcttctcttagtttacactctcccaatctgtttactctccacacgcccaccccctccatctcccaccgctatacacacactgaccctcaacatttgctcccccatcttcagccaccacttcttcccttcccccctggaggcgcttgttgacatggtctccgtggtcttagtctttaccggcgaatatatgattggctttcttaaccggtttttggggaatccggaccaagggaggccgaatatccatccatggctgcacatcagccgtcaatattgtaggagccacagagataggacggcaggccaaagccgcgagcccagtgcggttgtaatgcatctacctcccagcagcctttgcgcagacgccatgccagatccacagtgattcccgttcgctctggacggagttggaactgatattcgctgccccctcctagtcattgtcagactctttaataaagttataaaacattcctcatgcccccctgataacaacctcccctcttcttgttcctcccttccttcatcatcacacagacgccgatcagcacgcgcacatacgctcagcctggtgtttgttgcgactgtacattccccccatccaatctcactcggagtgacatagtcgtcctcgccccatctcacgatgctcagctccctcgacaagcaagaggtggcgaaggcctcccagctggagacttcgtccacggagaagcacaacaacgacaccgatgcctccttcggtgaggtcgagaacgccggcttcggcatcggcgacaccaagaagctcattcgcaaatgcgacaagtatctcttgccgttcctctccgtcctctacctcctgtccttccttgaccgcaccaacattggcaatgccaagctcgccaacatggagcaagccctcggcatgagtggcctggattacaatgtgagaattaatcatctcgtcggtgaggagttgattctaacgcttcaattagatcgcggtcgccgtcttcttccccttctatgtcgcagccgagattccctccaatatggccatgaagcgctggcgcccatccatctggattcccagcatcatggtcgcatggggaattgtcaccaccctcctcggtatcgtccacaacttccctggcctgctcgctgcccgttgcgccctcggtatcgctgagggtggtctcttccctggtatcacctactagtgagtctcagacaacatgacgtcaattgacgctttattctttttgtctctgatattttctgctaacacgatgtgaagcatctctttgtggtacaggcgccatgagtgcggtctgcgcatggccatcttcttctccgccgccaccgccgcgggtgcctttggtggtctcttggcctttggtatcatgaagatggagggcatgggaaatctccacggctggcaatggattttcatcatcgagggtctcctgacctttgttattggtaatgttccccgacccgaaactcatcctgtgatggtggctgacccttcaccccctacacagccatcgttgccttcttcgccatgtacgattatgccgacactgccaagttcctcaacgatgacgagaagcgcgagatcgtccgccgcctcgaggaagaccgctccgtcctctccgacaggttcgacatgaagttcatgtggcaggccttcaccgactggaagatctacgtccacatgctcatcaccatcggaatctacactcccctctactccatttccgtcttcatgcccaccgtcgtgaagagtttgggttacaccgccgagactgcccagctgatgaccgttcccccttatatcgccgcctgcctctgcaccatcggcggcggatatctggccgacagacacggacagcgtggtatctacatgattttcttctgccttgtcgcgtaagcattctttctgtccctctaggccccacttaaactgactggctctcatagtatcctcggattcgccctcctggccggagttcagaacaacggcgtcaaatacttcggatgcttcctgattacatgcggaatctacccaaatgtgccgggcggagtggcctggaatggtaacaacatcggtacgatcaatttaagccaattttcatgagttttggatgagttttggccgagttatgctgacttttgtataggtggttctctgaagcgaggtgttggaatcgctgtaagtgacgccaatttgatgacaaacactagtacggcatgctaatttgagtttagatgcacgttggattcggcaatctaggcggtacaatctctgccttcgcctacctccccaaggatgctcctcactaccgccccggccatctgctcctcatgtccaccacaaccatgagctgcctcctgtgcattttcatgaccctctacctccgccgcgagaacaagcgccgagacgctaccaacaaggcccccgagagctacacccgccaggagaaggaggtcgaggcggacaatggtgacaacgccaccttcttccgatacacggtctagattgagaatttttaaagcagagcagagtactctagagatttattgcatattaacgtatatttttctgtctatcaacggttatctacgtcaagtattctatcatgatatgagtaggaggtaaaaacaaaataatagaaacaatgtctaatataagagactgttttaactgtagatgaaaatagcgaaaagcgagcaacttaatagtcatgtgaaagtgtttacacataagacgctacacgattttacctgctatgcatgccgggtcgacggatggaagcagactgctcgcgagcaggggtgggaatgtggtgctgatagctggaggggaaagttggagaacgtaagcataatcatgaccctagtcaaaatagctaaattatgccgattcaaagtattgtaagggcgagagggtgcttttatggtgggtgtggtttagttctggcaatcctcaccccaaagaaaccaacataggaggaagaggcaacattcacactcggtaacgtcttcttcccatgaccagcaaaagcaaagcccactaaatcagaacttcagaaattgatttttgaatcaaggttatggcccgtttctatcagcccttgagggatggggagattgcttcgcggcagaccgtattatcgcaccccagcgggcgagatgtaattccatgccaaggttttaccactcgataaagtaggcctgaagactttcctggagtacaaattcttacaagatacatgcaacatagtcaaatgctcattgcataatactgctcgccaagttatcgccagcatgcacaactagctaaatggccatgtctctcgaagcttatggttaaaaaagaatgtagcagtattggcctagctctatcattgtagtatttgaacatcaccgtcaacaccaccatcatcagaaccatcgcttacggatctggcaatgtcccctttcaagaaccccttggtaactgctctcgttcaaatgctaaagttcctaaactgatatgttagctcccatcttatcaatcatactgtcactacccagttggtttaatcaactacatttcagttggatgagttgccgggatattagtacttagtgagagcaatggaatgcaccgcacgcctttggcggaaatctcagcacagccacgacccagatcggccgttaccattttctatgtgaatagcacgagtttgaagatgcttaagcatcgaccaatccgaatcatactatggctatggagtgacggtcatctccatctatattgcgccatgttttatttcagctacatgccagtctacatgcactcgtcaggcaccagtgaagccagttggtctgccatcaattggaagtttgcaatcatcacttacagcgattccaacacctcgcttcagagaaccacctatacaaaagtcagcataactcggccaaaactcatccaaaactataccaaccatctcatcgcagccttgtctataatcctgaatacgatgcaaccacaaatgtgaatattgtattgaattaaagagagctgtgcaagacgatgttctgtcccgtcgaactgataacaaagccacaaagtgacgccctgacaatcgacctagcgtagcgtgccacgataataacctcagtatacttcataccctattgctccattatatattgccgcacatgacctaatgagacgacaagaatttgccagatatcggaagattggcttgtgaaacactgcgagtagttcaatacgcagcctcacttgatttaacaaaaattaagagccacagctgcagcacaatatctcacaaacgagctttgcttaaccacgccgtcaataacaacagggttctagggtcaagcatcttcctttttgatactacggtcatctgcgatagatgtagctcgaacccattttggcttcgaaacaattggtatttcagatttcaacatactgtcgatggattataactgagttgttcaaacttcttctgttatgagaaaattccctacagctgatacatccggctgaagaaaggcgtctaagtcaggcctatgtgttcaatatctcaggatcaaatccttgtcagctccccaaacaagagacccccccgcattaactggggtcaatacaacaggccattagaaagatcaacatcattaacgtctatggcaacgcgtaccgtatcttagaaactagcttcaaggtttctgggttaatcacgtgacccggaaacaatgacaactcttccgtccccgcttatcttgtccgctttgcttaggccggagccaaaacactccgtcatctccgtcctccaaacgctcgattcttgccacttcatccctggtagctatggagccgtcggtagaccgatattctggggaacggaagttaagacaagcctgcgagcgatgtcggtatggaggtcctacctagttgacagcaggagaaacatgtgctaacagccagaacactcacttcagccagaagaagacccggtgccccggagagcgacccgagtgttcattttgcaaacgattaggtcaagtctgcttttatcgtgagcgtgaaacaaggacaagattctcttaccggaaattctctcaggggtaagtaagctacgcacctggatgttctgagggtggcatttttgctaacattctgtcaggacatcctctgaggaaagggttcgtaatcttgaatcgcaagttgcgagtctatataaactgcttcaatcaaacccaagccggggtgacgtttcccccaaccctcttgtggagcaaggtcaaatgcttgacgcccctcagtcgcaacgaccagcacaaggaaacatatctctcgatagccctacttccgatggtaatgagacctcatttaacccacaagaatctattgaatggttagattttcgcatctcctaaattttctattgcccccataccagacactaaacgaaccaggtcatatgaatctccgatccttacatcagatattatcaaccatttcattgccgtgtacaaagccaaaatatacttccaaccacttcctttattctatctacagactctacaggatgatctcgatgaatcgcctgaatatcttctgtggagcttcgtagctttgtgtcttcattatacaagtcatgactatttcacacgaccaaaggaagcaatcgagtactaccgccagctctcccagaaagccgtcaacgatgaagttgacaaaggagtcacttctacgcaggttttgcaaacattatgctgcctttctctatgtgatatcattggtaagcacccatccagataacaagaaccttgtgtataaggttacgaaaaagaattaagggctaattgatactagctgagcagccaagggcttggatcaatatctcttctttgactagactcgagacttttcggagattgagcctgcaaaactcatatggacggattcaagaggacgaaaatagccttagatgctattggagtgcgttcattctagaaaagacgttcagtgctcagtacaccatgttagaccaaacaatacgcacaccggagtatccccccagcgctccacagccagcgcctgttgattgtagcagaaactactcacaagatctcacctatagcgacgcagccagtaagaaagatgccggtatcaatgcgtattgcctcagagcgttgtctctgtggggcgatgtttctcaatatctgcatggaattcgatcaggcaaaaaggaagacccttgggtgccagagtcagctttccataaagtcatggcggacttgtttgagttcgaagcacgccttgacccgagatatttctttcgaaatgtgagtttttgcgatagatctcttgctgagctcgagagagatcgcgagttttggaccccatggttactaatgcagttcctgtcgcatgccgcgctggcagtgctgaaccatccacttatccatttaatggggtttaaaaccaatatccggcctcgcctatttcttcaacatacagttgagcaagccttgtatcatactggatgggtggttcgtctcatatcctcatgccaagcgttgggtttcgtagttcacgatcccttcatcggccagatccttgtcagcatggctactatcatttggtttttccaatttgctcgagatgaaagcgtgtctaaaacagccgttgaaaacatgaacgtattggaaagccatttgagtcaactgtccatgacgtggccgcacttactttgcgcggtaagtttattccctgtccttctcactctgcaggctgaaatctttaatacctaacttctcatacaaatcctagctagaacaactcagagaacttcaagtcatcgccgagaataagaaaaatgataacccaaacgaccgagcacaggtcatctttcaacctctaaagatctggagaattcttgatccaaccatcatgtgtcaaattcaaagcggttcgcccatgtctgtcgcagaccaagacgactcacaatcctccagcgatatgataagggtggcaacgacgtttgtacaccccgttgttgaggatcaagatgagccagggcaagactttgcactggaaactccctcttacaactatccacaagaacaccaaccaggtgaactttcgctagaggaattcctcggtgacttcttcgaccccagcccttcctggaacttgttgtgattaggtgaaagacaaggaaatttagcatattttcaatactggcacaagttgaataactgcacaaaataaaagtatttctaatatccttctacaagctgaatactgaacatgttacatgagacgtcgtctagttaatgtacaaaaaaagcaccaaattaaaggacgggacatcgcagtttgggtttctccattccatagatctgcaaactaatgtcatcaatctatcccaatcgactttacagacctcaagataaaaaaaggaggattcccccatagcttcatcaagctttagcagggggttgaactgccgctagggactaacctactttgccgaatcggtgccgatatcatggtgcgttgctggattccaccatgataagctctcgttattggccatccgtaactaacatatcagacaagtaactaaaatccgtccgtttgctgctgttttaattccgtactcgcaccttagccatgacgtacgcctaattctacagatattttaacctgaagtcacccctctgacaagaaacttaatcttcaacccagagcaaatcacctcttttgttctcttcatctgtcttctacatccaaaatggctagcaaggcatgctgcgagcttgccccggtgactgccgactacaacggcaaaggcagatgggagacaattgccgggataaacacctgttcgtcaccgcatgtctagccgcccaatcgttacgtatatgcttaccaaatcacagacattgttggatctgaggatgcagacaaggctattattgacatctatgacatctttggagttgcatctcagacaatacagggcgcagatcgcttggccgcacacgcctctgtacttgtctttgtcccggacctgtttgaaggtaaatcacttgacaaaggggcaatcccccctgatacgcccgaaaagcaagcccttctccaggaattcatgtctagctccgccaacgttacttccaacattgataaggtggccaaaattcgtaaggcgattggcgaccagtggccctccattgaggatcacattgggatctttggtctgtgctggggtgtaagttcagtaataatcggcatactcaggatttccaactcaatcattctcacacacattttgatagggcaagattgctattctggtatgtggggaggccaacgagggcaagggccgcaagttcaaagtgagcggaacagctcatccagggtacgactgttcctctcttgctatccgtcatccaagccgatcgaggacttcaaattgaacgagtaactaattatcgaatacagcggtttggacaccaaagatgcggaagctacaaacgtgcctcacattctccttgcctctccaggcgagcctgctgatatcgtagcagaggttaaagaggtattttctcggcccggcaaaaccggcgttgtagagacctacccgaccatgtttcatgggtggatgggcgcacgagcaaacctcgaaaacgaggacaatttaaacgagtacaagcgagggtatagccaagttggcgacttcttcggcaagcacctataagttcccagggtaaaacatcaaatactaccgtgagcggccagataaagatggctcctcttcagtgtgtctctcagaaagacctatgtgatatggtaacatagtgctctcggcttagctcctcctactcagctgcagctctgatggctgccttcttgagattttttttttttagaaaatgctatttataatgcctccagcttttcaggagcttgttacgttgtcgttctcatgcgaaagctacagaaactcttaaatgagccttcgtaagtgtttagtgctggaaagagtagtagaatgtaggattcagaaaagcacggcgatgagtattgacagtgtctaaacaatgcttcttcctcagcccttgtttactgtaatggtgccaaaaacaagttgaaaaattagcatcttctgatggaaagtggcgacgagggactctcccatgcacaccaaagctcttttcacataaggcagggacttcgctttttagtgaacacaataatgagagaataaaaactgttctaggatatttatcttgatattgtatttattactagattgattgttttgatattgtgttgaaaatgttatgtggatatccttatcgggtggatctggtcactcgccgactaacccaaccttccttcacagaagtcagagagttaactttttcttcaattatcatcacattcgttgctttgcaattgcttacttttgaattgcttacttttgctttgcgtaaaatcacacagtcgcttaactaggcaggtacgccatagtcacaccagcctaatcaaaagataccaggcggatacctaaggcagacatcggtacgtgactctggaagcacaagtccttaaggtgtccaaagtttttggaatttcttctttcttctttcttctttcttcctcacaatcctccctctactctccaatagagaggcccgcgaggctcgcgactccctttctatcctcatagacatgctcatgacaatctctctctacacccgccgaggtgggctaacgacaatctttctctaaggtaagtaggatcaagaccccttgagtccttattaacaagtacctatattctgactagattatagatgaataactactctggtagaggtggccgcaggggccgtggtacggtatgttctgaccttaatttccaaatcaaacttgcaacgctactttgaagagaaaactcaccttagcactagaattcgtgccaaaacctggtcggaatcttcgaccggatgacgacgctcctggttagggaacaggctacggccgcggtacagtatgttcttaccttaatttccagttcaaacttgccaacgctaccttgaagagaaagctaaccttggcactagaattcgtaccgcaacctggtcggaggtttcggccagatgacgacgctcctggttctgttcccgaaccaggagcgtcgtcggcgatcaatgcgctgttccaacgtatgtatctacttactcgccaagctcttggcaaccaattttcacatcaaatatagtgcttgaagaagggccactgggcccgggagtgctgggctccccaggccaatgcacagcagcccagccacgcccggcagccacgcccggcagccgcagccatacgtccagaagccgcagctatacgtgcagcagcctcagagacgcccagcatccccaattccacgaattccacgaccaggagcctcagttccacgatcagaagcctcagttcaacgcccagcagcaccagctcaacgcccaggcgccccagttcaacgaccaccaagccggctcctggccggcacctgggtcgcgtggaggcccaggggggttgatgacccctgggccgatgaggtagaggagatggggaggagaattgaagggttatagttgataataataataggggtccactcgacacctactacaaatctctttgctacccaccacttgcggcttgatatgaggtataagactaatactgttggacgaataagactaatattgagtgtttattttgcttaataatgtgtgcatattcaatctctggttgtcgtgtgttgtgttgttgttatgcaataatcccccttctctcggctgactgctcaatttgagtgcaaaatatgtcgagagcaggtagagatctcggacgataggcaagtaagtattgacaatgcagtcgattagcaacagtgagagaaagtacttttgagaggttcaggggactgggactcattggtcaccatatacattccaggggactgaaaatgaagcaggagacactgtacacacaacatatcattttcgagggaggggtagtatataggagaatagttaggtaagccacaactatgctgcacttttcatctcgatgacaccagacgagcatcgctacctaatacatttctacatttattgagagagatacagtacaataagtcacactgacctttggttccagtacaagcttaagagatacaaaattttttgaatctgattgacccaaaccatctgttgacgctcatgcattagaagtttcccattgtatagctgtgtccttcattcagcctcgacgtgtatctcaaaagttctgactagcttaatatgcaccgcttgtgatattgttggacagtttaatcccatcccaaacatctcccagccaatccaaagatacttgagccaattgagcctcagcgccaatctggcagtgctctccggcacccaagtcttgcttgaactgattataagtggccaagctacccagagctgccgccagctcctgcggctggcctgatcctgccaaagtatcgtgttcaccgtccccgacgaaggtagggcaggtgatgtttgccactatttcttcgtcaagcgcgattttactcaaacgggtgaaccactcaaatggacttgtagtgttgaaggaccacaacccttgcgcaatgacccatctgaactgtgttggcacggttgcgttgttcattagaccaagcatggtctcgtcaaacacctccgagtttccgctggcaaagaggttgttcagagcgtctgggagttgagaagtcaaagccttgaaaaggctcattaggccatcgatggccaacacggccgagatgcggtgctccctcgatgctgccattggcgcaagagttccgccgaatgactcgccgatgagagcaactttttgagcatcgacatccaggcgactctccaagtaatcaacgatcggggtgacgacgtcccaccaattcgggatgaaaccaatcttctgctgccgtctcacagtgggttggcctggtccttcgtagctcacataattccaaccacgctcagtgatggcgcgtccgattgaatgatagagagcctcctgcgagccatcatatccgctgccgacaataacggtagggatcctcccctggggccgagatgcattgtgattcccatggccaacagttgcggcagggaaaaacatgatcgggatgtcgaagccgtcgccagttagattcttcctaaagggtggattcggtaggaggctggtggccgtgtcgaagtcggccagtgccgagtcccagaggctaaagatacgagggtcactctggttgctgtggaggaaaaagtcggctccccgatagtagctggcagagcggaaataggtatcacgggcagaaacagggaaacgcttcttgtcaatggcgtctgccttttcatgtagagaatcggccatgtatttgaactcagagtaccaactttcgaagtcgccaggggtaatttggctggcaagtcggagaactggagactcaatcaaatccaaagtcagatcatttatgctgctaagaaggaatacttattctaggagtgcgagttgggcaaagacataccttctccggtatttgcccctccaccgttggaaaggctcatgtattcttctaaaaggaatgcgaattctgggtcgctgctcaattggtagataatgcttgatgagttctcttgctgctgcccaagctacaccattattagatacatgtgctcataaacaaggatagaatcatgcgaggggatgaagtaggactcaccacatagacagcaccgaggacgaagaaggtgctagtgatgcgcatcgtgactgatattaaaatggtaggttcgggggtttggagaggctgatggtctgatggtgaagcttgaagaactgatttccgcactgttgaaaggagaacgaaccctactatttatacttattttcagcgttctcgttcgcgagggtgccctttctccgacttattctctgcactagcggcttcacagccgggtctgtctcccatggctgatggattaccttttctggacattgcagagcgggaaccatgtgtagctgatggatcactaatctaaagatggctataagagacgaatctggtggaggcctacgtatggctgacatgtctggaagccaacgtgcaccatcatctccggcccgcgcggcacttcagcccaacattaaactacggagaacttagaacacagccttcgtctagctcggttgtaaaaggtcctggcgtaaggaaatgctcaatcaatatcaaaacgaattaacaacttctatcacggctagaagcatgtttaacttgttcctaagttacttcgctatgcagcttggttgtactttcactataataaagaggcaattaatagtggtttgatgaaggatgtcgagccacttccatcatacttcgtgagggatggatattacaaggtggcgagtgcaacctggatagggttgtcgtttacgtagtgggttctattgggaacgagaacgagctcgaatggatttgccgtttgtggaatagctccggcagcatatcatcggcgaagtcggcatccaaacgccgcctgtagatcgcgtaggttgggctgacaacagtacccggaggaacggcattaacgtcagccccttgcgtcagccctttcttaaccaacacagggagaaccaaatattgacaaaaagagagataccagcgcggtttaaatttgggcgtaaggaagcctatgactttgtccagaagcctttgacaggctatctcgcgttacaaacaaacttcacctcttcagcgcctaggaatagggtatttcaggcgcaaacttactattgacaacctcctatgagatatgtatatacctacttcaataacacaatggtgagcctcatgtccattaaaaaaactcccagttgttgaaattatctttgcatacctagtatcacaggttaaaaactacgacaatcaacctcctctgggtcgggttccataaactgcaagctcaacgggttttactgaaataatatcatttatctgtatggatgaaggagatgaatagcctcagctatttaacgtattccgacgcaaaacatcactccctgttcacttccccatgaggtaccccatattccattgtagctatgaagctaacatagagtctcaagcacgatgaacaaacgtagataattccaaaccagttccaaatctaaatggtgaagaatgtttccaagttttgccggacccaagtcacttcatggctccgaagagggagttgtggttcgccggccccattgataccaggcccttagttacacttgaagccggcagtgtacccgcagtggcgagagcaacattcgaagttgaacttgcaatctgttgaaatcattagtttgcccttatgaaggagcacagactttatacatacggtcgccgttgtccctgcagccgttggccgcgttgcgctcgtctagaatgttgtccacaccagctggcgtctgatcgctggcaacctgaccagccccagtggcgggtgcggcaaggacactcgcaacgcacgcgagaagaatgatggggtatttggcgaacatgttggcggagtaaaatgttatatagaaagatgtagaatctgaatgaattgatgaactgatgagtgaggttgatgatgttttgttattcccagactgggaggcagagagcgtttatatagcttgaatattgacgcttccatagcaactcgacaactaccggttaggtaattgcatcgaatgcatacgtaagaaagtgcatcattgacgatccgcacgaagagtacagatacccggctaccgacatgacgcggagtccacggcaagtcttgactcgtttcatagcctctgtggaatcttggcccttggatgatgcattgctggcaggcactatttcgatttggcaataattactggagaacaagcctgggacggcagcatgtttcacattttataacaatgcagggatgaatgttcttcaatacgtggtatctcaacggcatagctgtcccttgaaaggtccgaactacatgacctgtaacaaagtcgcagcttcttctttgtagttcgtccgaagttcggtttcattcctcgggaactaacatgacactagttggcaagtatcacggttcaagggcgacagatccctaccgatgcttcggctcattgtcttgaagaagtatcgccgtcgcttcgggccttagaatggccccaactgtccttccatttcatcatttatcaaggaacacaaaataaagatatgctatgtacggccgtcaatccattcggcaatatcaatcgacctcaagccaaccgcacgccgccggccctcaacgtttctgatgacgaatgtgttttcgccactaaccccagggacgccatcttgatttcaaggagtacaagcaacgtcatctgagacttggttcataattgcaccggtggcgaaggggcttatgggggaagtgacgtagatgattcaggatggagaaatggaatgtttgacaagattccaagacaggagaaatttggaaatgggcacctgccgttacagtagtttagtcccaggtatctttgccttgttctcattgtccagttgattaagtcgtcactataagccgatgaacgcggctgtgctattgagtctcgctcttctaccgctgctattcaaatttagggtcatccattaaggattcaattgtcctccaagatatgaacatgaatgctcctattagacgattcaccagagtagtagcgcgaggcaggcccagacgcgtacaaaggtgcgtttgtccttcatagcaaagaagtatattctatttaacagtacatctgccttagggcccgcaatctattcccatttattataagccaggagggtacctagtgtaggaccgtgaaatggcgggtctttgtcaaagtgccttgatgaagcgtggagggcccagctacggatacctaggataaaacactatatgctgaactcaatagtgcctattagccaggtatgattggtagaataaaaaaggtgaattaagtttaaaataacattcagctctacatgtgctgcttgatttattttgctctctgcaatagcaaaatgaaatttgcgattaatgttaaaagcatcagaagctgggttgactctgtcactcgcaaggaaggctcttgatacaattcaaaatttcattctttctaactgaagacttccatcaatattcccagataacaaaactgcgggcgtaattagcccgaaatttgtggtgatagtacatgcatttcaatccgatgataaatcaaaccgttcaaccctgtgaacaccttcctcctgtcgagatacacgagctcaatgcgattgcttacaatccactgctgttgcattccgatttcccttttcttttctttctttctttttctctttcgtttttagagaatgcgattgcgaacagcggatagcagccatcatctaagaccgggatcgcctttcttgtcgaggcgatatcatagatcctttccgccaaatgaattccaaaaaggctaggaaagccctagggacctcgaaaatctttgttctttttcaaacctggccatgtcctttcgttccttctcttgcagctttctcagctgctgccttcccaccctctggtcagggaagaaggcgagaaatatatccgggtcaacctgaaaggtggggtcttcttcaatggcctcgttgtgaggcttgatcatcatgatcctctgggctgtgctgaggatgtaggcccggaggagcgacggcgtatagtcctttccggatatcataagatacgactctagctcctccatgcttgaactggaatgtcctcttctgtgggccgagaggttttcgagcctcctcctcagggtatcctcccccacaatcctgaatgtgatctctagataacggaattaatatcgagcgcactcaattacagtctatgcattctcacctctcatgttgtcggaattctaaacctttttgctcgtgtgtatgacagcacctagcgcaaatgcgtccgtatgtataaatgcgattaattaggaacgcaaaatacaccaagaaaaattgtaagagaagcgattgaaattctttatccaacgaagcacaagatgaggagcatgcgattacacaataatatacctgcgcgcgcctgtgcaacaaatagccaaatcttttaggctttcaatgcattgctgtcttacgtgaaggcccggtcacggggcaatcgagccatccgggagcaaacacgagattaataattgtacgttttctcccccttctttctttccttttctcaatccagtcccctctgcgcccccctgagttgagctggcaaacatgtggcagcgtccaccggggatgacaattatcgggacaattgcgcgcaataccgcttcaacacgtggcaatcgagaattgagacctgacgagtctcggttgcgacccccgtggacctgcgtcagagaatgcacgaaattgggctcccggatatgtcccgtcaggcacatactcagggcgcgcacgtcgccttgggctgtggttcaattaacacgtataaggttgggtaattgggagataggagggtgtcatcaacccagggtatatttaggctatgatgtgctatgtgagctggggaaattatcattaagatacttgggaccaatttagtagacatatcatcctactgggcctccttgttggggacctcggtaatagcctcgggctcgggctcagccttgggctcccccgactcgtatccaagctgggtggtgtcccagcccttgctctcgaggaaggcgcggaagcgggcattctcctcggcgatggtgtcctgcccgacgtaggggacgaggaacaggcagatggcggcggagaggacacacaggctggaggcaacccagaaggggtactgggctgaggtgacctcgttgtcgcctccggccttgacgatgtaagggaagacccaggttccgacgaaggcgccgatcttgccggtggcagctgcgataccgtagtagcggcctcggacgccggtggcgcaggtcttggaagcaaggagaccaatgttgttgccaggaccgaactcgccgagggactggaagattccaaagacgacggcgaaagcagcgatggacttggtgatgtgaacatagacaccggccatgatgaagccgataatagcctgggcgaaaacaccagtggcgagggtgtgcttggggccgagccagtcactgacgaaagcaccaatcaaggtaccagggatgtagaacaggttgatgacggtgttccagccgaaaatagttgtcaggggcgcatcgtcgccgtagataccgctcagaatagaggaagagtagattccgaaagcatatgatgagaactagctggggattagcatttaagcactcgggataaacacatgagaacctacgttatagaggaaccagatcaagctgatgcagaagagacggaacccgtagaactggaagacaaggcggtacggagtctccttcttcatggactccttcttgtactcctcgggctccttgagtctaaaacgaagaacaagaagcacgataggaaaaaccgctccaatgcccaagctagttctccagattgtcccgtagtgcgtgttgtgagcagcagcagcaacaacgtctacccacggcgaattagtcacagaattctacgacaatatcaccacccacatcagtattcactcacaagggacgaaagctccaatgacaaaaccccaatcgatcatggagttggtgaacaggatgaaccatctgttacgggaacccttcttcagatcaccagtggactcggcagcaccgacactgccagctggatattcacctccgataccaataccgacgaagaaacgccaggcagtaagcatggcgaacatgccgtcaggctctcccttgtagtatgatccagtggccagaatggtgaagacaatcaagatgatggtggagagaacaagggcgttgttgcgggaccaggcatccgacagataaccgaaggcaagctggcccacgacagtgcccgcaaacgcgatggaagagacattctgcgaggcagagttgttcttgtagagcgcgccatactgcagggcgaggacagtgttgacggaaccaatgacctgtaggcgcggcattagctacgacgttctcccgcgtatcatttcacgtccacgacagtacggctggtggatttccaatgtgggacttgcgttgttgatgtagccgtcggagaacagaccagcaccgcaggcgaagacgggcataatggcctcccagaagggcttgggcgcacgctcagggacgacgggagcctcgaggtcgttcgagtccccatcctgggagcgcttcttgaatgacaggtcaaacatgatgaatcagtcgcgtagcttcgaagcgtcgtcgaaggtgcaattgtacagtcacggagtacctatgttggcctgtgctcaactttgccgacttatggttcacacgagcgagtaaggtttcacaaggggagaagggtgcctggaggcgactttatagatccaaccttagccccagagatagccaagagaagcacgtgggattttcaacgacacagttcagtcatgtaacatggagcacgtgcggagagatagccaagagtatggagattggttcggaggagggtataacgaacggggagggccgtttgtcgtcgctgagaatcctactaatttagtggaaccaacaaggacggggaactggtggcaatggaggcaaccagtcgctagcaaacctcacgcggtgtcgccgtcgactgggagatggtcgggtaagcatcaagggaagggatcgtcggtcacagctgccgcgtcagctgccgttcgacgagatggaggaggcatatggtaacgcaagtcggcagcgtccacctcgcgatctcgctccctcccaagcctcgacatcccatctaccgtccagcaaaccatccgcagcaagaatcacaagccaaagactggcatagccaagggaaattggctaatcctgtcctcttggctgaacgctgcaggcaaagtgcaggaatcgcatttgccagcttcggaatagtgtcgtgtgagaaagctgcaagaagacggggccaagctccactcccgcttggccaaggtcggaattcggcacagggaagagcctcttgcttgtgctgtgtccaggcgtgtgaagcccaatccggccctgggtcgaggtcaccgtgctaccattcaccaatcctcataggcccaagcatatccgcgacatcagcgaccgtcatgcttagagatggatttgtgatacctcttcgcaatggtcagaccacagggttgcgtatacggcgcccaccagcggcaattgctcgagcgtctcatccactggtcaagggtgttggttgggtcagtggtgatttttctcctgcatttctcggcaagggcgacaagtttttggcctgaggatcagccgtgcccacaggcaatttcagcagctcggcccgacactggccaagtccctctgcaagacactatgaaactctccttctgtcactcttgatccaattgtatgcgatcatcatctacagaatctccaccatgcgagatctcaggcactcgtccaatcacccatggcctttcgttcaatgccaattgccaagtgcacaattggttgctggtcaattatgctcaatgttggacccttggacgttgctcggaagatttcataaacagcgatgccgggaatagtctggtaggatcgtgtttatttttaattttccttcattattacttgtgcttggcttggcctgtgcctgggactagttgggagacagccaattaccccaactccaaccctgctctgacctacatgctgtctggggcttcagctccagctcaggctgaagccagtcgtaggatctctctcaagatgagggagctcttagtcatagaattgtacggctccgtacttctgcacgattgttgaccctcatcccatcacgacgagccgttttgatgggttcaagtcccaccaggctgcttcactaaccagcttcctttgggacgtcacattgactttgtagcagaagcgttcagtcatcctgaccaacatcagtctcaagcctgtctttccaacctcgccacgctgagctgcgataacaatgaacggctgcaattccccgctctcattgacgtctgcctttttcaaatagagactagtgagtctctcctcggtgattgggctaaggacgaggtattcctgaaccaacgatgcagcgttcttatacaaaggccgtagcttcaggaagctcaagctagtgtagaagcaaattagtcccgggggtatttgctcaaggctggaggctaggctagcatattgcgactgtatttgcgataaatcaggggtgaaatattcgcggagtccaggctgaaggctgtccaagacgggtgattccaaaactggttctggtagcatctcagcgccgtcggcaagtttgaagaaagtaagtaagcctgccgtttctccaggccaggatgtgggctcgatgcccgtacccgcctgttccttggtgtagatccatcccatccaagaccaactaggaaatgcaggtcgccgagcacagcacatcccccagaaccaacagccagatattatctgagcaaagtacctttctgggattccatggtatattggcccaatgaggccttccatcatccttgagattccagcaaacgcattccccatgtcatcctctcgggtgagagtccgctgggtgtactgcttcacaatttttcggaacaaagatactagctcctcttctgaactcgtaccgctgttctccagagttctcggtaacgaatgtagaatagagtccccccgaggattttggacattttccaggtggagatcctctctccaaaccgccgttgggcatgaaaacaagaccacagatggtagaaatatgattgctcttgtagagcagacttcttcttgaagtgtccaacctcttgtcctccacttagacgcctggagcgcctgtcgtggatcccgaagaactctcgccatgggtgtgtcttgaataagaaatggtttgtggagatgttctctctcttcgaatatgctgacacccgaaaggcccaagtcgcagcttggcccatcagctgccacgattgtggcctccgcttggtggtatataagaaacatctggttgatctgctcttgtcgctgagaatcgtcatcttggacgatgcataacgcatcaacccacaggaaccgcaaactcgtctgtttcgtgatggccattgcatcacgaaccttttgagtaattgtcgcttcctctgtgaggctcccaggctcatgccacttatccagtgttaatctagtcaattccgcctgtgggacgccaccccacacgtaactcaaggcaagatacggcggtgtgtgtccatccgtcaaagtgaccagacagttcttttctgtgtcgaccaagataaggttcttaggtttttgcccggatgtttcagtaatgcatcggcttccatgatcagaatgacatctgtttaaccacttgttgacaagaccgatatcaaattttggttgcacaaagcgggcgaagcagggcttgtcggatgaaatgggaacgtagagaacctcgtcttttgatggctgacggtgaatcgcgcggaagccttcctcaattggctttttggtagtcctttggtattcatcaccagacctgagtgcagcctggtttcccgcaggctttgatgggtctaattcatattcctgaaatttcaaacctttccaggtttcctctgattgtagttggatctgaactctgtctattagactccgattgtaggaccctctgcaccatggaataggatggtcctttaaagcttgagttaggcctgctggatgaacttgatacagtcgcttggctaggccatcgagactctctggggagcggccttcgtgaatgcaccataaacaatacttggatgcttggtgtcgagacaatggctgttccatgacacgcagtatattttcacacaatgagatgaaatcattgaaagcagcagtcagcacctcgtcggggtagagtagcctggcctcttgtattgcctcatccagctggctaccgcaatcgagagcttgcgaaggtgtatccacggaatctggccgatccattactgaaatcttagctttaaacagatctctacagttctgtagcttctgttccagctttgtatttgtttctatggctgattgtgagattggctggctagccctgacttctccgatccatttcttgagattggagtagatcttaagatatttcctactcatatgtaagcttcatgcctcaatttaattcaagtgaaattgattgtttcatttcaaatacatcagattctctcgtcggccatgacatccgcctacaatgctaatctcatcttggatcgtggtgcacatctcgcacggcggcatttgttcttcaggaggtagcctatggataggctcgaattcccaagagtagagaacagcatcgttttcgaaattatcgctcgtatcccaatcatcgaggcagcgcttaagagaactcaaggatgaacaggccgtgcacccattgtctcgccttggaaccacgggctgaggtaaaggcaatgggtggtcttggtcccgcgcaacggcgctcggcactggcgattcatgttcctcctttttgctcgaatcatgaggccagcgccgtatcaaagacttgacgaatcgctttgccattgggggagactgtggtgatgatgtagctttttattagaggggataagcaaaaacgatcaattgattcgattctgattggggtagcaaaggcagctgggctgactcgactgcttggcagtggtgtcataccaacccgattatgccttacattttcggctaatatgacatggcaagagggggccctcagaataaaagggactgcgtaggcgtttcgatcgatctcaactttccaacaagccatgatattgatagagaatagtccataataacaatagttctttgagtaatcattaggtattctaacgtagtattccagaaggggaagtattcttatgtggctggtcgccacgatagatctgtcgagataactttacaacgacaccctctaattaactccatatccgtacaaactccacaagccaatctttcaaattccgatgctgctaaacgtatgaaactagacgtaaagaaccataaactatcaggacgggttaccatttaagaagtaccaaagcaaaagagaccaaagaaggttaatatcaaccacaaaaaggccaagtattctaacctctaatagtatatctacatggaagattaaaaacagtatcggtgatcattatgactcatttagaatgccgaccaatggtcatcaaatgaagggtgctcaattgacataaatcgaagtatgttgcgatgattactgaattcggttggtgatctacatgtttatgattattgatgcaagacataaatccaattccccctctgtctcctaacaccattatctctacctctctccttcacctactttaatccaaaacccttatcccttctgaagccatgtcagcacgaatttctttcatatcgaggatctcagcaagacctaaatcctcgcaagccatcctacccgccatctggttgagaagtttctcccgctttgcccgcacagcaccggcaacggaggtcgtcaaggccttgaaagaggatggctgcatcgtcattgaatccatgctgccatcctcgcaggtagcccgtctgaatagagatatggatatagccttggccaatatctctcccgggaggccggccaacgccaatacagcaccgctcccggagggtgccgatgcagccgtatttggagccaaaacgaaacgcctagggaacatgttgaactccagcgcgacgtttcgggaggacattgtcaacaacgacagcctccacaatatttcagccgaaatattcaaggagaccggcgactactggctcagcacggcgcaaatgattgagattgggccggggacgaaagcccagccactccatcccgatgccgtgggctggtggccgttctggagcatgggcgaaaagtggatgccggagttcgcggtcaactttttgatcgctgtgactgacacgacgaaagagaatggagcgacgggagttgttcgtggcagccacaagatgagctacgcaaacgctctggacaatccttccgagctgtggaagtactcggatgatgaggtcgagcaggtcgagctgaaggctggagattgtctcctcttgggtggcaggattgtgcacaggggagaggagaacaagactgatcatgaacatcgcagaatactgagctgtactatcatcagctcagcactcacgccggaagaggctcaccctttgctactggaaagggacaaggcaaaggagctgtcggaaagagccaagaagtttctgggcttccgcgagctttcgaccactataggccctgatgtctggcaggatcaccgaaaaggtggattaaagaaagccctgggcttctaagcagggccggatatggttcggtttgatgccaagatcctagggctaccctatgccggaataaacaattctaacacactgtgggaagctggctaggcacacgaaaattggaaactccgagtgagttacatgcattggaaagaagagattattatgtatattaacaacaagatactagagcagttgtatgatattatgtttgcgggaacaaagtccttcctcaatcaggtgcaaatgtgccaccacccctgcgataggaccttcaattccaatcctggtggcagcttgcacgaccttcctccacccaattaccgacatgtatggcactggaccagccagtttcttatgctcaccgtcctgcggtgtgcacttgaccaccaagtgtttgagtcctgcagaagtgtggccggtttgcacagccaccagtgctgttgcttacacagccacagtcctgcttgacgagctccactgtgatggtgacccttctcaattgatttgcttattggcgggttgtagaattacggcccccaagcgaaatacgtgcagacaccgaatctggctcgtcgaggaaacgcgtcatagctggtgagagccctgacgaagggttccgcctgctgctctgtctggcgcttttgtatgttagcaactgtatagagtgaggggagagcttgcataaaagttatgaattcatgtaccttgcataatatgaatttagggagactgttgatccggctgacccttggttgccagtcattgacgatgtagtcgagtaggaaggcatcttgatgtacgtgagagggtatcaattgagcaagtgaagggagatttttcatcaatcgttgtatggcttttatttgttctgatcaagtgtgtttaatccatctcatcagcgtcttctggcctccatttaaatagttcgcctgggccagactcgtccgcgttgcgcaaaactcacgagtcctagacaacgagttgaacttccacatacgggaactttggaagtcagttaaactcgtagggcggagccacgcgttatccgcatcagaagcatgcgtcttaataccaagtccacctgtctgattccgcgtctagttatgcgcatgctgcttcacttgcgcaaaacccctgtcgcttcgccaaggggccctgttcacgggctgacacctcaaaccaatggcatgacgcacacaaggtcagcatgcacgctccgccgccttggaataagcgctggtcactggttgtatttgtggttcgcgacctgcgacttctcgtggaattcttcctccttgaacttcaattgagggcctgggacctttgtgcccaattcctcccttccctccacttgcacttcggactattgcattctttggcgaaaaagcaccacttatacctggcgagtgacttccagccatcggtacagtatcggagcgtatcgtgcgccccatcggccatcgggtagtcaccatggatctgcctactcgcatccggcgtggcgcccaaggcgtttcatcgagaatcgggacacggaacatcgcagggcgcacggattcagaacaacaggccaaaaagcctacacagaggttgaccgaacgttttcgggcctacaaacgttcgttgtcggacttaatattggggccacccaaatcagcagactcgtttgtcacttgtgatggccctggccaacaaaacactgagagagctgcgtttcccgtggccctgggtgctacctgttcgtacgaacactcggacgcattgaaaaagccaccacctgaacctgcttcccttctagacaatgcgggatacagtatggaatcagtccgtggccaagtgaatgcgcaacacgcctcaacgcttcgtgacctcactggagtgggaagccatctcccaacagacgatcgagggattgaccaggacagaaagcgaaggggtaagataacaatttcattaacagagtgtcaatactaacatgtctcactagactcgtatcgcgattcgatcgttgggcatggatcttctgatgagtacaacgttaaccttcgttttgtaagtgggaaacatcgaacaagactggaaatcagtagtctcctaacacatttattggcattacagtcgagtccaaggagtacgtttggttatcccacaaggacatcgagctgcacaaccaactcatcgagatctgagcttccggacggggtgcagcggcataaacgatattcgtccctctgggcatatgaatcatttgccgaagggtcgactacagaatcgatcttcagcggaagggcgcagtcgactatttctatttcctcagtcggcaccgttgaggccccgatcacagatgaggcccgccccgccgcgtcgaagcgacaaagattatcgtcgtcctcgacaggcacgttgtcaagttactacaatgatgtcaacctggaagagaatcccttgccaacgccgccaagttcggctggcctacgaaacttcagaaagtctattgatcgttcttccgctgagagtttgaacatcaccaaccaactacaaaattttgagaaaccaacgaagaagacaaatggtgatcgaccagaacgacctgttttgaagatagagcctgtaagcggctggctcaatataggcgaaatggatgaggaaacatccgcgaaaccactcagcgtcatctcagaagggaattctgacgccgcacactcgttcatggatacaagccctatccagccgtccggcccgtttgacaaattacctatccccccgaacccgactagatctagtcgaaggtcattctcagattctacatctgagattccccattctctcacttccccaaagccgatggtctcaacacgtgccacctctattaatgaacagtcagagctcgacgacgcgagtgaagacgacagccttctttctgatgacatcgatgaaacggatgatccatttctcgaagcatttgcagcctcctctttggacccaaatctgctcccattcgtactgaacctcaaagatcatttggtgaatcaagttgcatcaagagtggccgattgggtgagatcacacgctattgggtctggagagtcaggatcgggagggtcctctagtgcaaactttagccctaataactcgagcggttctgggccaaggaaatctggccggaagaggagctttttcggcgagggtggcgataactccgagagggaagatggagatgacgagcaaggcaagaggcgaaggactgagcccgacctcctcgacaggataggtcacggactcttcgcttgcccgtttacgaaaagatacccggagaagaagtggccaaaatgccacaagaaggccttcaaagaggttcaccgtatcaagtaagtaggcttagacgaccctggtcccctctgtaacgaactaacatgatagtagagagcatatctataggacacatatgcttgctccacactgtgagagatgctttgctgaattcgaaacggaggcagagcgggcagcgcacagccggcaacaggttccgtgtgatgttgttgagcctccagctaccatgatcggcgtaacggtcgacatcaaggatagattgaagtcgagaaaagggaaacagaactgggacgaagattcgaaatggagagcaatgtacaccattctgtttgaagatcaaaccgaaataccgagcccttgtaagttgtcacatttgccatacttaacagccagcatgctgatgtagtgaacagattgcgaattcgatatgtctattgggcctatgagccaagaccaatgtacgcagtttatccaacaacaatccagtcactgcgagcgggagattagaggcctcttggaggagcgactacaggatgagcccggatatgatattctgcgtgctcgcgtcttggagacgatcagggaggcttttgacacatacttcccagcaacgacagctgcaactcctagttcagcctccaaaatcgaagggcaccaagcattacggaaatcgaagtctcctgcctcgacgctgtcaaccatagaactaaattctttcgacaagaagaatttatcttcacaccaatctacgcctatcgatggagatcatggagcaagcagcttgggagatgcactacagcctagaaacgacctttcgaatcggtttgccacagaacttacggtgcattcgacaccagaacctggcagtgagagggatctgcttgtaccattaaaagtggatggcaacaatgaaacacctgaaccttcatgcactggtggccatgagggaggcatgctagccgggttgtatgatacccagttcaacttttctgatgagatcggtgactctttttacttctacggggaccgccccttggaattccttggggaacacccttggctgaccgagcacacagagcctgcagttgagaatccctaatgaggtgtctcggaggctgaaagtgtaataatagtaatcacagcgttttatggcatcggagcctgaagttgcttcctttccctgtatgtttatataatttgatttgcatcctccacttagttgaacttggatgggtttctcttctaggattgggcaagaggtagcgactggatcgcatgtattgtttggatgttaatttatgatgaggtatgatggagcacaagaagcaaataatactaggattgattcgatcttatatatgatatcaccgcctgtcaagttcgctttggtgggatgttcgttggatcgcctagcactcccgaggtacttactaagtcgagtgcggattgtcactagatactggaaccacttgataggtatcttagaggtcttggctctcgttttctcccctcaatggtgaaatctaagacgttttgacgttattgttctctctctccctattctccgaaaacaagctttctaaaaggccgcccacgttaactataactccatgtgctagttgacagccgctctttgaggtaaaaatggagctgtgtcaatattgaaatcttttgcgttaggtacccagcttcctatgacagaggtaaacatcaacgatgatgtcaaacgattcatgccccggtagtttggacttcatttaaaatctaactctgacggtaggctttaccttaattagaacaaggttgtaacctagagttcccgcctttgcgcccgaggagatggctgtgttatccctccacatatgtggtgttatcgctgaatatttgttttacgtcacagagctggcaccagaaaaaagtagatggacaagtaacaagtaactgaggaatgaatatttgacaaaatctcaacagaaagtttgccatctcgtcaatggaggcctccccgtaaaggatgtctagctctgtggggtgcagagatatactggcgagacaaaccatctcacaggcatcaaggtctcgactaacgatgcataaacggacacgtgccttgctagaagcctttgctaaactttgcggaacttcagtgactaatcgagaaattgtctggagaatccgctaacacgattgcagctgttggtagaaatagggtaaaattccgctgtgtaacattgggacgccgctgcataccaggcgattcccatgctctgggaccggattcatctctttttttctaaggcgtgcaatcatacaattagaatctcagatgtatttagttgaaaatggcactaatgatgggcttctgagacatgtacgcgtcagtaaattcacatatcaagcatttcatgacaacggaagaagccctcgctgagtgcaattttatagaaggcattgggtcaaagaggcacgtttgaaaacccaggttcagctgaggttccgcatcccgctagaaaggttcgtcggcgtaaacttagggtcagcgacatggcgtagatcgagatccagcattcctgactgctagcctgtggatattcaacgatgatggtggctgtggatcgaatcatgccgtttcgatgggtcttatcccttggaatctaaaaggactggctcctccagttcaatataagcaacttctgttgttagtaatcgccgtagagcaaggcctttgccgcacgaatgggctcatgttgacacaacccagtttctttcgtttaacgtggaggaaatatgctcaaacttacagggaaagggctcatggtaacaagctaattcttttaaagttgaatactgtcggctaattctggtttaggctattgagtggtccttaattggcatcgctcttcttcttggcctcgcacgacttgatctacgattcaaccatcaccaacaaggatttatcctcagagacttgttctattctttcgcgttggcgaccgcacttaccaacaccgctatcgacacggctttatggcaccgcgggataggagtatttgaggaagatgttgatttcggggtggtgcagtggaaggcacccagggataatatcattgctgctttcagggtaagttattatgacaactcgaagattctgaggggaaaattacgaggctgatcgtttttgtatccaaagacaatttatatctcaatctttacgttttaccttgagcagtacctgactaaaggcaccctcatcacgcaatatttcgagcttttcgggcgtcgctcgcggcgaacgcgaactgttttatatctccttataggatattgtgctgttggtttcatcaccacgattttcatgttacttttcatttgtagattaggctgcttctggtatgcctagtcttgtatttcttgatgaaaggtggttgctaattcttcacaggtcgatagaggctgaatgccgcgaccaacattgccaactgataaaagacaatgtagcctgggcttttcatttcacgtcagatgttatgagtacgtataactgatgggcaagagacatgtatatcgaagatggaggattgggaaagctaagaggtataacagttttcattcttccattagtctgcattagtcggttgccgatgtccagagcacaaaaaatcagcgcaggtcttacttttggtctcggatttatcgccattggaattaccgttatgagatggttcatcgtccactcaccgtttgcgccgtcgaccgctttcgccgtagatggtaagttgctggccacttttacgttgcaagatcggagctgagatgcaatatagaggctcttttcattaccgacgcccacacctccctcataatttctatactgccatcgcttcgactatatctgcgaatattccaaagaaaagaggacaaataccgtcaatcacgtgttgcaagcgtccttccccgggaaaaggcaccccgaacggaatctgcaacatataaagagatatctcatcctactgcagctacctcggtctcctagggatagggggcgctcgaaccatgaatataaaaccccaaaatgaagatcgatcgctagttgcgacctactaaagctcaaccgggtactgggtgactcaagtgccactgagactaggccgctgcatcaaaataacgaccgatcttgtgatgaatatcatactggagcaggaaagggacggatcaacgttcaggatcctcttttcttgaccgcaagtatgttcactaggtatcatatatgactaaagagatcggcgcaacatgtcaatgtggtaccgttgtttgacgcccggaagtcatgacagcttccgctcttcccacctgcctaagaccgtatgtctatgagggaggtcaacgcccagtatcgcaccgatgccgatccaattcttatcacattttggctacagaaatagcggtatggactatttttctgcgggactattggtgttcaaggtgatgaacacataaagggtcataatgacatttgggcggatcgcgttcgtgtttcgaatcaagtcagttcggatcaagattctgcccgctatttactctgcaatacgaacgtatacatagacacccaatctatattctagcaagtgtgataattacattttgttgcagtttactaatctgttgacactttgggcttgttacatacatacatacacaatgattggcatagttcatataaaaagaaattggaaattagtacttgctatctttcttgagcacgccccggaagatttaagctggtatctggcatctcatagatagatgacgccttggctgctggagcaaaccccttaatggcgcttggggcggaacggtccattgccgggatatgacgaacgtccgcgtcgcttttgcttaggttggaactgtgcggtgtcgcctccaactcttgtagtggtgtcctgcgtcctatcgagttcgctggcaactcaatcttttccgtgaaatcctcccctttggatgagacaaccgtcgtggagtaaagagtgtcgccctggtcaacctgaagcccctcgcttgtatctggagatgcacgccgaggttggttgatttcccgaatatctcttgaacttcttctacgcatgaagaagaagatggccaacgccaatatcaaaagtgctgctaggacgcagccaacgatgacacctatcaaagcgccacctgacaatgctgcttgttgttcgccttgatctgatccctcagaaactgcgccagtgccggtgccagtctctgcattggtgcgcgtgcctgttcccgtttgagaagcggattttgagcttgacgacgagatgattgtcgtgcgagacgtcaccgtaccaacatcgattccacttatagaggtagggggaatgacatctccagggattgcccaactcgatgccgaattaaatgtcggacacgcgggcgcagtctcagtcgctgtataagataacacgggtgtcacgggaggattgatggtcgagaatacggtcgaaagcgcgctgtaatcgtcaagcatcgaaggagtccccgtctgggcgctgtccgagtattccacaagcccgaaatcgctcgactgctgagcccattcatatacgatggcaccagagaacttgttctggaaaagaggtgacatcatcgtttgaatctctttgaactcgcgtttgctgctcccatttgcaacacagcccgtctctgtgaatactatcgggatattgtaatgctcaaaggtctcgtataatcggtcgaagggagttggtatggaactcgaatcgccacacaagctgtaagagtcaattccgaacatctcgattctgctcttagtatcaccacacgccaagaactgtcccgacagtgataaatgtggcccgacggaggctgaagaataagtaacgggtatctggcggtagcctctggcatccctaaatgctcttatatccctggcagctgctttgacagctatagcaccaaggctacctttgtctttgagaacgttagacgctccaactatatcactcgattgtgtcatccaacgtactcgtattatctaagacctcggcaccaagtgtaaaggcgagaatgttgtcatatccggcaaaatggtcgacggtggaagtgaagttgttatataagtcggctgtccatcctaattttgtctgaggtaaaagtgagattcgcgtgcactatgtgatgtataactcccatttacttaccggctgaattcttttggaggaagtgctcaagtccatccaaacgtaaatgtcctgacttgaaaaagcttccatacagtctttgtggtctttggtagaatcggccccataaactcgtatagtattgacaccaaggctcttcattagtccggcgtcgatctgacattgtgtaccgtcaagcaagacatcctgctctccgtttcccgtgtaaatgactcctggtgtaaatagcctttgatcagtatagccgaagggcaggggggaagcaagctgaggagctaacctttgacgaagaactgttttccgtctccgtcgtagagctttgcgcccttgacggatatgggggaaagtgaagctgcgagattagtaaacaaaagaaccgcacacaccgccgaaactcgaagtcccgtacgcatcgcgtagctcttcataatggacgtatacagtagcggaaactgtccaacaagcgacttctcgatgtcgattatgaatcgatccgtgcctcaccggtagaacagccacgatccgacgtttcctccgcgggtaaggtgaaagacgagtctctagaggggtgatctgagtgataaagagaagcacatatgtttgagccggcacttgttgcttactttgtgtgtttcaggacctattttgggaagcggtagcaaaggatgtaattaagctgacagcatatgccggggtgaaggcctggccactaggatcatcattctcaaaaaggataattgtttccaagctcaaacactggtatccttggcagtccattcaagcgaggttcgctacgagggcacaaatcagtggcttattcgacctagactttccgaatcttccgaagtcgtttctccgaagtcatcgcgccatcttagtttagacggtgaatcctgaacactgactacataggattagaaaggaagtcatgacataactcgactatttcgagtcttgatgagctgatatcacctacaaaaagattgggaaattatcctcaactggtctagtgtcccccaatcttgaggtggacgggaccgaagactagccatgcgaataactaaactccgctgagataatcaacatggttctcactgctcagcttcttgatccggacaaccctgcccccaggcacaaaaaaattaagcaaattctagcgcgatccctgatccttaccaggacaatatgaatccggcatctgttcaaagcgtgcagccagctgccgtctttcagctaggtggatagaggcagggaagtgggcggcatgggaaataatatcccgtgattatttgtcttacgataggtatattaagtttaataacaagcaaatattatgaattcttcatcgctgtcacattgttgattcttgtgtccctagtgagagccttttgaatggtaacttctttctgatggaatccatctagttagagcagagtgagcacatgataaatcacatcagatgaaaagcagcaatagcctttgaacaggttgaattttaggcaataaatcaggaggaagcacctggcaatgaaatctgtttcggccccacgggtgatacagaaacctattcgatgacctttgttgctgattgatatacggacatttattacctattaaggagtgacttaatatcggccgcagacagtcaatcccaaagaaataaagtaaaggagaacatatggaaagaaaagcgacaaggacccagaagaaacccacaactagagaagcgacctcatctgggagccatatactgccagtgtcgagggtaaccagaagctttcggtatgagttctacatcaactcgcagtgatctccatctaagtactagctctactgtcggcatattcgaggagcttagtgacgtctctctccataaatagccatctcagggagtgcgaggcgagatcgcatttccgctctatgggatctctctccccccgcagctggaatttcttaacgatactcttctgggtcatagatccgccatggtagcaggcatcgcaaatccgcatcttgtcccatccccaccagcattggttcgcgccccgtccagccttggcaccacgacaaccctgacgcttcgggtgctcgttgataaattcatatagtcggcttggatcgccgaatattagagcctcggaaagcatctcaccgtgtcgaactgaggctggatgataatagttgcgccagcacaccatactttcccctttccgaacgtcggttttagggacgaagtagtcacccatcccctggggcttgaggttcccgtgataacagcgaccgcagatagcataggacctatgaatgtttccgggcaaggtaaaccacatggtgttggatactcccttgggttcacattcaggccactcggcaccttcattgagggcgttgtaaagcaagtggtagtcatccttttcttcggcggcgttaatgacagccctgaaccttgatgtagccatgcatctaccaccattggggagttcctcaatccgcgtgaaatcgttttcagccttggtgccaacaaagaaggtgtggtagcatgctccacaaaagaaatatggctgggagacaacaaaacactgataccatgtcgccttctttgccaattttccaggcttgagctcgtgaagcgggcaagctgggagatccagtcgttcttttgtcttcgtgacaaagtcatcccagcttgatgggagcgttgaatccatcttgagcaaacgcgcaacgtatcgacaatgggctttgcaatacgttttcgactgtctcacttgtcgctcgaaatgggtcgcaaagccggtcgatgctatgcggtcctcgtaacactcctcacacaccgtaaattcagggaaatcggcggaagcataccatatgtcgcctggtgcgcgagacgagctctttgggcaatctctcactgtacgagcccagatgatatggttgataaacttctccattgagccttggaatgcagcttgattccatactctcaatgtcatgtcaagtcgtttgaactggcaaaatcgtcgttttcgatcgaccggccggaacaaaacaaactccttatttaggctcgtattggtgatatggtcgacataacagcgaccacaaatgagaaaactcggttcggaagggtgttgaatccacgccacggatgcagaggttgcttccttgatgcataattttgttggctcgacagaggaggtggtggctagttctggggtgggcgctgagcgtagagcattctgttcttgctcttggtatggcggcaggtcattaacaagctcccattccgatggatcgaacttgccagcttctaaagcctttgcatttttctcggatgggctacttgtcacatcatgtgtttctgttgtcgggttgttgcgcttggtcttattacccgcgaggaagccaccaatcgtgataaagagacggcccagacgatccatgatggatggcggcaaccagaatgatcaaggagaaggtaaaggttggctacaacgtcacacgttgttgttttagtatttctgctgcaagtctaagagagtcgggacgaccggcaagcacaaagcaaggaagcggggaaatagacttatagattgaccatgaagccaggcgcgccagctgcccgaaattagttctttgtccacttcacgcgacactaatgaaacgggcgaaccaggcagggaaaggcgacagtcttattattctcgctggtgtatgcggtgccccccttcaaggcagattctcacatgaatcgggcgttttggtggagccagtggtgctgtcagcattcggattctgctcactatgaagcaggaggccaggcatatgtgcacgtattgcgttatcttgtgctttcggtcacaccgctgggctccgttgattggagggaggactgaggggcgttgcccgacgtgacgtatcaatgcaatatgcatcattgcaaaacatgcaaaggcgcgtgactcttttggacaggcgaccttttctctgaaatcgattaagcaggcgggagagaggggtctagaatatgtaagtaaacggccgatgtatatacagttttcaaaggcggtatataaggatccatgaattctatgaaagaacgtgacgcgaccgataaaggcctctctgatatctatgaaggatgcccgaacattatttgctgatgcttccccccgcaagaaagatttctacaggaaacatttaacctcaatagataaaaaacactgaggtaggtagacttacctagggcgccctccgcgagtatggtaaaccccctttttatctaagaaaatttctatcgattttgaatccttcagtgcagtatcaactcgagtgttgcccttgggatatcgatatcgatgatgatgccataagtgccacgaggaagtgtctgcgtgacaaaacggcatgaagcagcagtaaagctatcttgagctgtcagctccgcggacgttgatgctgcacgtattgattcacgcttggatttagcaatccgtgcccattctggagtgcggctggtaacacaataccttgcatgttcaaatttcgagctactgcaagcgcgatggtagagtggagcgaaaggcatcacgtaaaaacaagcgacggggagaatatacgttgttatatgctaaatggccgtgaatttccaattatttcgttcccttcttatgaatccttagttcttctgctatcatttccaacttctcctgtgcctctctgagaagctcgcgtgccaatctttggcactctcgagcgtcctctttctctatcccaaagaagtcctcatccacactagtctcccaacagtcctcatcctcctgtgactctgaccattccgaagccgtgtcataagaatcacagtaattcatttgagcctcccaatcatggatctcctgtattctgttggacgcttctttccatgggctagtggtctcgtgggattcagagcccaaaaggcgatattcgtctgtttcaaacctcgtcatactgacggtcttgatactgcggaccagctctgaaagtataggtgaaggcttgcagagaagaggctgggcgtatcgattgaggagaggcagtctaaagggtttggagatgttcaaatttgagtcgtaatagatcgagtgttatagcaactctctgatctttttttatggacagatcttcagcttagagagagatgtaaagaagttttgcctgctatcatcggcgtattgggacgagatggaagtagtagtctggaggtttagatggtattgatgaaaagaaatctacttccatgagtttcttttaacatatttatagagcttcaaccgctcgaatgtcaaataggtcaagcattacaatatttgacacttgcgaatattgtttcaaaattggcggtgcattaacaggcagcgtgatgcattgggatggatcagctaccacattcggagggcccctgtatcagaaacgtctcgcatcacttctgcgattgaacgcggttggcattaaccaataagcttccttcatttatttaaccaaccttctcagtactcaatcagaaattataactggccaatcttgggtacggaggttactgcaaatcgttcgccaatttgacccaggacgagcacattcgggataacgtgatatatttgtctcgtcttgtactatgcgcttgaaccccctgtttcattgggaagcattctaatcaatttttgtagactatggcaccatgatcaatttactatcgtcgctgatctgaggaaatgatcttcagctaatatcctccttcattgatgcgttatcgatcaccccatccattgtgtgcgctgccaagcctccggtccttgaactacagacgaagcattccgtttgattgaaaataatcatcaaactaatcagaaataactattccttttgattatatagctatatttcattgcgtttcctattcgtattgcgagcgatgtgtcagaatacagtattgaggatattagagcatcatgttgttttgcattcacgcacgtaattccatgccggtaactacttattccttactatttaaatcctaatcaatggctagaaaagcctcgcctctctcggcagtactattattcacgtttagaaggtctctttctttgttcacctgaataggagggaatatcaaaccgaaaatctcgcagggaaaaattgccctcagggtacggaaagtgtcggctagatgcctattgtctggctcgcggaattatctggtccgtgaagcattcatttatctgtttgttatcatgaacttagatctggtagcatatggggtgaaggatgatgctcaaagcattggcatacttttgtccgttcaatgttaattgtctccatccttcaatccgaatagcaaaagagggcttggcagcttcgacattggtttctatagcaaataccaacctctagtcaattcatcaaagtatcagtttcctgtctaagtatgtactaggaagactacggctgttccaagaggcaaagccttgtccgctttaccctggccatttctgcaaaacagtatcaaggggcctaattagcaataaacccagcccattcacctcgtaaagtttgcggctgaggtcgcctgatcttaatacaagcgagccggccaatcacccaatctccgcgttcgcccctccattgacctgatgagctccgcttcccgcaaggccaaagtccgctaacatgcataaatacaagagacactgcaggcggcggagtcaacgcaagtcggttaggcactaaatagcaatcgactacacctgaaaatggccaatattcctgagacaatgcggtccctcgtggcccccaaaaaggggccgccgagcaccttcgagatcgcctcgatgccaacgccatcgatcaaggagccgaccgatgtccttatccatgtccgtgcggccagccttggcacgggggacgtgcagattgcggggggtaaactcgaggtcttttataaggctacgttcgtttgaactcggtccaagacagttgaggggggaatggttcgctaacaaagatgacaggtttcccttgaaaatcggaatctccggtgccggtgtcgttgtcgcggttggcgacggcgtgaagcacctcaaagttggcgacgaggtctatggtactaacatatctaagcccatgttccgcataccgccaccagggtttgtctctgaatacacggtctgccctgagaatcttcttattcgaaaaccaccaagtctgtctttcgaggaggccgcttcattcacccccatggtagttgcggcctaccaggtaatcaagcgcgggctgcaagtccgcggggaagagagcctcgagggcaagacagtgtttgtgccgggcgctttgagcggcacgggatcgatcattattcaagtagcaaagaactactttggtgccgccaagatcatctctaccgtatccacagccaaagtccccctagtggaggaatatctccccggcatggtcgatcagattatcgactacaagacgcaaaaggttggagatcttgtgccccagggcactgtagacttcgctgtcaatactcagatgtcttcaatggacgactgcatcgcagcgctggacaagaagaccggcacgttgatgtccatcactagcattcctaccaagaaggtggcgaaggagattattggcgcagaccggtttccttggtggtttggggtcatactcgacttggctcaatactactacacgtggaagttttggggaacaaacatctatcacgaaatggtttcaggaagccctgacatccgtgaggatctggagttgtccggtgagatagtggctttgggtaaggtgaagccggtcatgagggttgtagaactggaggatattgaggcggtacgaaacaattgtgaggaagtatatgtggtcaagggtggcattgggaagctggtcgtcgtcatttctaaataacatagccctgtgcgacccttcagtactttccgagcttacttcattaattttccaatatatctctacttgctacattcaacaactacaactcgaccgtcctttacgagtcctgaacacacattgctcaacattccactgttgcttggtcggctttgctctacctcaatcgttccgttgctgtcatcaaatagagctccggcaacattaatatcgccgacgatcacgagtgcacttcggtgacgggataacagaacattcagccggttctcgcatctcataaaccctggcccagacttctctgtagagaccatgatagccacgacgatatcaccttcccggccttggaacgagtctacggtagcagcaggtggcataccggcgaggatgtcatagtcgcttctcttccgcatcttctcaatcgcatggacgttcgctttgtagggggttataaggcagatgcgcgctgggtttgtttggctcgctttcacgaacccacctaggaatttgagggcggctgtattctgatcggtattttgactcgacatggcgtatctccccttgggtctctccctctttgaaccgcggcagtgaatgaaaataggcgatagcgtgccctgaggaggtggcctcagctccgggaacctacgaaccgtgtagtcctctagttggttcccgactcgatgggcaggcgtgcttatgcgacagcacggggcatactcaaaagggagatccgaatatagctcgcggtggcagatatcaaattggcctctggccatccggaactgtacgcgtagacgaaggatgggccatccattcatcttgaaaaattcaagaggcgaaatgattccatccgcatgatgccgattgagatattttccacttctgtccctttccttctctgtcttgaccgtaggccgaagttggtgctcgtcaccagctagaaagcacggaagcaagacgttcccccatatacaatcgagatcaggcctcgtcatgtttgcggcctcgtcgatcgctacgccacgagctgtttttttccaccccaggtagctcaaatgttgggatttagctggagtggtcaagagaatatctgcattgtcgatgagaagctgtagcatctccgaaatcaccccaggctcaaatacaccggcatcaagatcttcccagcgctttttaccttccatgatatcccggaggggagcaagatccgtttggccatcgtagaatttctgtatatcgtgcaaggctaagctgtcatcactgtcaagttggcggacggcaggagatctcaaaaccatcaatagccaatacgttgcggatagatcaagcttccattttgacttgggcttccactccttctttggtgcggcatcattaccctcctttggactctccagcagctttcggaatgcagcgatctcgtcggcaatggcatagcctcgtataataatgatgcggcgtattctttgtgtggttttcaaagctccgcctttattggcctgcttgatagcctcgtcatcaatcctcgagaggcgctcggcgaagttgtctacggccacgttggatggtgcgcttccatatactttgccctgcgaagctctcatcacaagcgtggcaaccgccagtgcagttgttttcccaaatcctgggcccttcggatagtgagattcatgattattgaataaagattccagagtgctaacataccgcagtgattactccaagccccagtggacggtttctcaaatattccctgatgcgtcctcgatcgacttcgagaaatttctgcaacagagcttccaaatactttggcttagctccatccagaagattcaccacgggaatgagtggccctgtagcttgattctcatcgatgtgaaaattgttgctcatggacgcaatcacatcatcggctaaaagtgtacaattgttaaacaggacccagggtataagcttgggtttgaatacgtactgcttgtgctgtggtgaattcctgaggagggatgaaatccccttccacgctgaagagccctatgaagctccatccgtctttccaggctgatagccgatgtgtcaatagcagcgaggtcatggcttgctttagcgtactgagcaaattggcaaacagcattgacctttcgctcacactctttcagcttcggatcaaacaacagtgagactgtagaccagctctgtggatccttgtccttgaagtcgatggccgtattccaatcggggaaagtaggcagctgcatgactgacttgcctcggcgtatctccaatatcaaggcgggcaccctctgctgaagatgtgggatcaagggtggctggcctttgacattctgcacaagtctggcatcccagcattccacggccaatttataccacgacccttctcttgaaagccgtggggggccaaatgtgtcgcttggcctgaggaaagccagtttgaaagactcacaatctgtcagttgatcccattctttcttgtactggtgcctgaattcttctttaagctgtatcacagcataataagtgtcataagtggtgtcggtctcacttcgtttcttccctggcacgaaataagccgagaatttggttgcgaagattttggcggcggcaagggctagccacaaggtgtcctggacaacagactgggtgagaacagcaagccggctatcatcgtcttcaaagttgagcgctcttgcgaatggaagacttcttttaatgccatatgagtcgtgtttgtatgtgtttggttgccatgaatggttgttgccgtagggatacgaaaatgccttggggagttgcctaccgaaacactcctttgcgtcaaggggatcggagagaacgacaatgtgaaactggcgcaacttgaaaagctcgtggagagttattccttgttcgatgggcaaatctcggttaagccatccgtcgcatggatgtccaggattggaaaaagggttggcatagccgtcaacagtgacactgtgccccccttgaagagttatctgggcagcggtcataggtttctgcaaagagaagcggtttctgagcccgggtatagaatttatatccttgaaagatatccgataatgtcctctgggcatttttgctttcaacttcagtgaggtcgcgggcaccgaccttccagtgctactatcatctagaatgacatcgttagtttgggcctcaggatccttctcaggctatgaagcgaggccgtcagcttacattcgtggcagactccaaaacctcggtcctcattgctttggtcgaaagggaacataagctcaaacccaatgtgagccgaagcgtcgtctggtgtgcagaagaacagttctgaatcgatctcagtcgtgacatcgagagacttgcccccaatcatctgtccattctatgaaccgatgattatggcgcaaggtttcgagaacccagacatcttgaaaaggattcgtgagctaggttttcattgaatggggagaccagttgtggggaaagtgtgcacgacaacaggccaaggaggaaggggactcgtggctattgttgccgtcgctacatttcaaagatgaggtaaactggagaaatggagggaaagaggcagaggaaaggtgaaggtaatgttatgatgtgcaaactggcggcgcgaaaacacgcgcctggcacgcgttgtgtcacgtcccgtcgctgggttttgacctgttgcctgcttgtcctcaggtgcgtccggtcgttatggggtctttcccacacagtagaggtgttaatcgagtatggcagacaagttcaaagcatgaaaatgagcataacccagagcagtattgactgtctcatccagccaataaggacacagccgtgcagaacgtaacagtttcgaagcaataggttaactccataggtgcgtttaatcttgacatactttaccgatttcttcatgattatccgggggcgtatttaacgtgttacgatgtgaagtttgaaattaagcaaatcattcataagcacatacaaaacagatattgactagccgcctcctttacagcgccaccatcatacatgcaacaaaacgaagttgtggcacaaataagagaaatattgagcatcgcaaatgacaggaagttgtaacgctctcgctacactcaatgaactataacacttcttaagcgatattttcacaactcatttgagaattgggttaaacgcttaccacgacatctgttgttccaacggtctgatacattctcccgatctgaacagtatactttacttggcttcttatcattcagacaactagcgcaactatatcatatccttgttcaccgctatcagtacactgcggaccaatcacactaactcatcgaccttatcaatgggctaggacttggatttactcccaataacagacggggtcgggaataggtatccaggggcaatccccgcctcgctcatgaacctctcatcattgtcggtgtaacatgacaagacactatttaacctaaataggtgcgctggaacgctatcaagactagcagagtcgcgacatgggggttaacaacttcgtctcttggcactgataactggcagggttccccaggtattttgacaaatgatacggaagagagcggcagaccggtacaatccaggtcaggcgacttgacgcggggacaagaaatgatgtcctggtcctgataacgggttacaaattgatttctccacgacaagggagggagagtctaagccttgtgagttacttcccttatctatctcaaagaaatggtagaagcggccgtccgtataaagctcactaatcagcgccactgcatgctttcaagcagtcgtcaggatccaaacagtcaaaattattcgttgctcatcatccatcttcattttcattatggcctcggagacaaagccggctgtagaatctacagtcgtggcgacgggtgaaaaggaggtgaacaatgagcacaacctcgtagctcgcaaaacacttctcgatgtgctcagcaaatgggaactggttctcgcctggattggacttctcctcgtgtcctttacgaattatctcgacagtgtcactgtcagtacatacttcgtctacgcgcttagcgaatttgaacggctgtcggtagaaggcgccttgtctgctatcttcggcgtcatcgcactaggtgagtcgataacttgcgctgtcgcaaatattacttaccaatcatgaaataaggaatccagggtgttcttgctactctagcaggagaaattcagtacgcatggctgggtcacttccccactccaatcatcaaagtctgacatttgttcttcagctcctttactatcgttgccgcctctgtatgcctcatcacccttgcatttatcctagaggcttctgcaccaggcatagccgctctgattgcgggcttcagtatttacgctgtaggactgatgagtaagagaccatgcaaagtttacctcgttcatcaataacttacgactggtagcgtctaaatttatgatatatgtgttaactgctggtgagtctctcatgatctttcacattctccaccttgcattcagaggctgactttggtccatagaattgagcaacatgagacaccgcgcattgtccttgggcgcagcgaatttgcctgccatgatatcacaactggtaagcgactctgcctcccagggcacaataacatatcagaaattgggaatcaagactaaattcctttgaacagggtggtgcaaagatggccgaatcagtgctccaaagattaagttggagatggggtatcgcactctggtgtatcatggtaactaagccctgcccaggcaaaacaaagtgattcctcgacagttgactaacgatatccttccacatcaagattcctgtcgcttcaatcccacttttggttgcccttttccttgcaaggagaaaagttcaccagaaaggaacgctagagataccagcatctcggaagcaaagagttctaggattatgggctaaattgctagagcaggacctgatcggttgtgcttttctcgctgccggatgtgccctacttttcctccccatccctctggagcatggtggcgtggaaaggtatgcttcggcccattgtgtcgctcccactgtgataggcttctgcgtcctcattgcttttggtatttgggaggccaagtttgctctcaacccactcttcccaacaaggctgattcgcaataagaatgtgctgggcccattgctgggtaagttctggacacttcaccctacgccgagtttctgatgcttacaaacatcacctagcgagcctctgtggtgggttttctttgagcttcctgctgccgtacttttacgtctatataatggttacgagccagctcagcatctcgagtgccacatacatcacgctggcactgacattgaccaatgccttcgcgcaactctgttacggcgctcttgtttcatggatgcaacgcccaaagtggttgtttgttgcgaacatgggcctgctggttcttggtggcggcttgcaacttgcctttcccgatccacattctcagctggctggcctggtggtagctcaaattgtttcgggatttggctttggaggtttcatgagcgttcttgtccttgctcaagcctcagcactaccgcaaggtgagtacagacactgaatgtggggaggtaacacccctcatgatactcttgctaataaaccgtcagatgttccggtattatccgctgcgtacattatacttgcgaacttctccacgtcagttgctggagcagtagctggagggatgtggaccagtaagtcacattatatatggggggaaagcatttgttaacaccaggtagctatcctcgtcaaaaaccttgagcaataccttcccttggaaatcaaagatcaggcaagagcaataatgggctcgctcactgtggcacaaagctacgaatggggcactccggagagggaggctatcatcttggcgcacaagaagactttccggcatttcttcataggttttatcgtcactgctgcaatggctttcctgctatcttttatctgtgacgatgtacacgttggtaaagttgacgaggaacggaatacagcaaaacgcagggctgaagaaaaggaaaaccctcaagcatcatgatactttattatgatgtataataatgcagctagaagtcgtcatagttttcgtacacttagcttgccatactcagggaccttcgtgggcatgccttacttctacctgtttggaatggactgcttcgagccaaggctgttccgcacaaataagattatcatatcgaaatgttcttttttggggggggattgacaagtcgccttgactaagaagcctcaaattctaatattatttactctgtgttcatatcgacttgtcctatcttggatcaggagccccaacaaagaactctactcctttttattctcactcaaaacctgttgtcctactctcctggagcgaaaggttgaacagccgtgtgcagatatattccacaccacgacagcataatccccggagggtgatatgggtagtcctttgtgtgctctggaatgttgccagatctgaggcaaattgacccatcctcagtttagattctgaagccgcgagatgatgctcgccatcgatacctttcgtaccatcagaacttgactccaagcttgaagttcgttttaatcaatcttgctccaaatgcagccatagttccagccaagtacattgtgcctgcgaagatcttgagaccacgaaatgagccatgctcaagctgaacgattgccccggcgatggggttcgttacaaggcctccgattgacgcgcatccaaagagcaggccagtccggtatccaaattcttcacgaggcgacacctcggcaactagagcaggagataaggagacgtaggcgccagagaagaagccgaaaaacgcagcgaagcatataatagccgcgttgctgctcgcagggatccaaagacccaaaataaggatactcgttgttgcgcagacagtcgtgaagacgttgaaatggccaagtttatcggcgacgagaccagaagaggttcgcccaaagaagctatagtcagtgtcattagtattttgatgtcgtatgttatcagttgagactcaccttgctgcgttgaggatcggtactatgtattgcctgatatttgttcccatgccaaaagtgttggcttccacaacaatatagtctatgggaacaaatactccaaaagtaataagaaagaacccaatcatgagaaacagcatggggagttctttgaatggggctgtgtagttcgccttgtgccctgccggggctgggcggtgcttaacccgttgccggaccgtaagattagcgatgatgagaaggcccaaaataaggaaagccgagattcgcatagtccatccgtatccgacctggcggatcaaccggttgagcatgatggggaaaatcacgcccccaagactcgatcccgttgagcagattccgaaggcggcagctcgcttcttgctgaaccaatcgcgcacagaagagattgcttcatgttaaggttaatttatataatcttttgcttcatgctggtccaattttagtgccatacctggttgaaatatggctgatgcaccgatagcgctacagacgccttgagaaagaagaatctggtagtactctttggaaatcgaagccatcatcaaaccaaacacatgcaacacagtgccacaaaatattagataatgcggtccgtatcgatcatacagcttgccaatcaaaggccccgaggcgaacatgaagaatatttgcagagaagggatccatgcaatcgtacttgaggagtatgaactcaggagctcgtgttggtaatagtcttgaaaaatcccgacgcctgggggagaaagaagcaggctgttagacacaaaagcagctatcgggtgaaagggagggactcttactgttgatccagccaaagctacagaacgatgtgcaccaggtcccaaagacgacaagccatgctgctgctcctccatctggaatatcgtcgttaggttcttttcgctcagttgacgaagactcaatgtcctgaacctgtttttcatgaaccgagccaaccttggcagcaatattgtccgctgccattttgaaaagagtggcttccaagcaggtttttcttttcctggcttctacttgccgggtttgtctactgggtgtatacgggcatcacaaaatgtgatgtttccagttctttaatactcagactggctgatgctattctgaaaatacacttgactcacctttcccgcctgccccggccggcaattacggcacggccctgcaagagttccgcagacactatggaaccgtagccggtgaattgcagatgctcgccccagtcgctccttgctcaagcccgagagcgggacagggccgaagacggttccaattagcccatctccagctagtctccacgttgatccgcagggctgtaatgtccccagtacgcccttcgctctactcctccccttggatgacatggcttcctcactttgaagatgttatgatcacaacagtcaggtgacttcttttttattttcctcatatctcgttggcggaaacgccaaatagaccagtgttccaacattgtcgatgctcggggtaataaacagcaactccgtccccggcatatgggctacccaggtgactcatcacgaattactgcctccacagtagggggatgagtggggagaataactgaatgcaatgcagtcccaagcgcgagctcaatggggtcctcatttcaccatgtaatgaaaatgtgggcagccttttgctaagttgtcgaatgcctggtttgggaaataccattacggctaccccaccagttacgcggaaaagatccgcgactaattcatcttttctgcccgtgaatacatgtaaagctgccctatatacgagcgttgagatcgttgttggttgtgttgcacttttgtgcaaatgcatgtggctagggaaatcaaccaaccaggtaacatgtatgaagaggctgaaaccctggctgtgaatgcggggttgagatcaagtcatatcagacatgaccttgttgctctaaacaacgaaacgaaatcaggttcttagtgaagttgaacattatttgaacatggggaacccaagcatgccaatccttacgatccctaccaaaacagaaacacacccacacggtggtgtttctccatggccgtggtgacaatacgaaaaacttcaccttctctctctccctctggcgcgatatacaaggccacacaatattcgatagattcccttcgttccgctgggtctttcctcaggcgcccacccgcgaagccaccagctgttccggagcatggcctccgcagtggttcgacgtctggaacgtgcgcgactttgctgacagagaagaggtccagactaaggggctcaagcaagtcgtccctattatccgcaatataatcagggacgaggctgcagcactaggaggcgactggacccgtgtggtactggcaggcattagcatgggcgctgcgacgggcgtgcacactctcttcaacttgaatataccagccgaaggagggggtaggctcggcgctttcttggggttctcttgtcgttgcccgtttgctgggagagacctggctggcatgcgcaatgtcctagagctggacaatgtgcccgagagtgacacggccgtagccaatacgcctgtcttgctcgagcactgcgctgatgatcctttggtactgcttcagaatggccagcagatgcgggacatcctgagagggtttggggctcaggtcgagtggaaagaatactccgatggtgggcattggttccaatcgccaaacggtgtggaagacatggctgcatttataaaccagcatgtcttgggtaccaagtcgctgaaccagtccgatccaatagatatatcttgaggtattagcatgtgcctaaggtacaattattaagttgatggccataacctcgcgggcattctctttccatggtacggctttggtcgagacttgtgccaaccgtgccttgatcacatattgtagctgttgtcgagactgttgaacaacttatgctaattgtgctaataaattagttttacgacctattttaacataatcttttgatacaatcccctaacgctcatacatgcttcagtaagttggcctcaaacgtgccataagcaaggcagctcacatcaactcaaaagagaataaccaatcatagaaaatctaaacaatcagagtcatttggatcacaagtgggaattttatcgcgaatttctatgaactcatttgtattctcaaatttggataaagcaaaaactaacgaacaaaagaagcccattacaagtaccgaatatcgaagttaccaatcccccaacgccgctaatgcggaaaattcatatgaccactatctagcaaaagccctctggtcgcgtttaaatccagttcttctgcaccatctagttgatggtgatgtggcgaggctcgggcttggccttgggcacgacaatgctcaggagaccgtccttgagatcggcggtgacaaagtcagcgtcaacgtgggcggggaaggtgaatgtgcgagtgaactcgcgcacaccccatctgcatcgctgctgaggctcctcggcggagtgttcctgctggtgctgctgctcagcctcagtctccagctgacgctgtgctccgtcctgggcgctcttctcagatgccttgtcaaccacctcgaagtcgtcagtctcgtcgtcgtcctcgacggtagcctggtaagagtgggtgcttgggctgtcctcggaagcagcctgtgtaggagcagcagtagcagatgaggaagatgcgctggcctcctgctcttcctgtgcggttggctgggaggcggcgtcttggtcacgctcgaccttgccgcggatcacaatcttctgcggctcggggaactcgacagtgacgtggtccttgttcaggcccgggagttcgccggtgagagtgtaggcatcctcggtctccctgacattgaatctggggttccagggacggggtgcaggacggtagaaatgataggcgcctccacagcgggagtacctgtcattgttgaccacgcggaagaccggcgtaaaagaggcctgtgggtggtaggctgagtgggacatgaagaaggccattatgatttaagaatggggtttagggtggttttttatttggttttgggttttggaagagttggattgttgtttgaattggtgtgagtgatgagaagatcagatcggccatatcggttcagcctggcagctttatacctggggaccatcgggatagtagtaccaggcatcctctggcagcgtaatttgcctctgtgttcgaaggttcaagaggtcagaagaatctgtccgtatttgctggaagtggtgggcaggtaggtgcttgcaccaggcctggatttgtcattctcgtctcggtgtacgttgctctgtaaatccgtcgctaggcgtcagtgcgtgcgtgttgagttgagcgctgtatttggtggtgtggcgcctaagtgtggcgcttagtaaccggacagggctgaagactggaaggttctctccactgtttgttagcgctaccggctctcactaaactccgcccttgggagatccgaagggcgtgcttgtcttgtcctgtccactgaatgtgggcgccacgatggtacgtggtacatcaaacctccagaccccaaacggcgagatgggagaagcagccctccgcaccatccgccgtcccaactgcgggagcatgaaccagaccctacagactccttagagcaccaccatcaagagaaagcaagcatggctaccctcatgcgcgaccccggcgagacgtcgctcgacacgctcctcgccaccctcaccaccgtcctcgaccccaccacctacgtcttcaccaccgtcccgggcgacaaggacctcccgcccctcagggacgtccagctcctgttccgcgaggacgagggcgtcaccgtcgtcaccagcctcgaagtcgccgccgccaggaggatggagtacttcttcccctgcaagcgcatcaccctcaacgtcacctctagcctcgaggcggtgggcttcatggccgtcatcgcgacgaggctcgcgactaaatctatgggcgtcaaccccgtgagcggcttctaccacgatcatttatttgtcccgctggggcgggagaacgaggccttggccgagctcaaggcccttgccgacgagaagaaggctcagattgggaaggcttaacttcatcaaggaatggaattcaatgtcctgggtgtattcaaagttcaaaaattaatttgggaaaaataaggaaatgtaattaccaatctgtgtgattgaagagtcagacatgcaacaatgaaatccaccaaaatggacatcaactcatacattctcccgtccgtcccatccatgaaccaaccaaactatgctgcttttcatccacatacatctcaatgcaccagccaccactgcgtcgtctccttcgccaggtcatcctcgaccttgctctgcctatacggccacttcttcgccctgatgtacttggccgtgtccttcccgatagcccagtcaagcagggacatgtagttcgcgttctgcaccgtcttgttgctgtttccaatctcgatccacttctcgaacgccggcagctccagcttcaggttctggttgaggcggtcgtacaggtccttgagctcggccacgggtcgcgccttgccgcccgtgcggacgtgcgcctccctcagccgctcgagctggagcttcgtgtcggcgacgatggcggcgcggcgctcgctcgagtagtgctccagggagatgaacgagacctcgcggaggacggtctcgtgcacgtccatggcgctgccgaccctcccgctagagacgtagaggctggcgagaagcatcgagacggccaaggtgtccgggtccagccgtccacgtccgcgtctgatgttgtagtagaggagctcggccgtgttgatggcggcggccgtcttcttgctgttctgctgggcgtggacgagcaagttgccgacgcgcaggaccatgatcggggaccagttcctcgacctctgcagctcctcgcgcctgtcccagagcttggaaagcagctcctcgagggttgtaaagttgccctgggcgccgagcaggcggatcaggccagacagatcctcgaacttgaggtcggcaaagtccacgccctccttgtacgctgtggccaggacgtctctcatgatatcgcttgaggtctgtttcatcgccttgctgagctccggctccttggggtgtgtcacatcgatgcccgccagcagctcggcaagcttgtagccgatgtggaagtagcgcgtgtggtggaagatgcggtgcttgatagctagctggaagacggcgcggccgacctggtgtccctgtcggaactcggcagcctctaggagcgccctcaccttattattaccggccttgcaggccagagcagggaagtcaatctcggaggcacgctggtcctttccaagctccaggaggatggcgaggtagaaagtgcggacgtgttcctctccgaccgtcttgaattcggcggcgtactgggctctgaacagctgcaaaagcttcttgtcaagtatttccaggagttgggtgcgcttgtgctcttcccagaagatacggagcttgcctccagcttcaagaatgacctcaagcttggtctccttctcgatgactcgggagtattcgacaaacaagagagactcgaagagaatatcggccatcatctcggagtgcgagatggttttgcccttccctaggaggcccagctcgaaagcgatcaggaagctgaatgcaaccttgctcagttgcacatcaagcttcagcgcgatctccgtggtggtccagccacctcggaagatgatcaggtggcgcaactggtgaagcagctcttggcccttgttcaccaagccggcactggtgtagatggatgccaaggtggtggcagcggcaaagagagtcgtagtgacagtcagcgtagtgatgatctcaacaacagactgctgcagtagctcaatgattctgatgtgctgagaattgaccttctggtacaggataaccagatccttgagcttaaggagagtaacctcgtgccatacgccatattcaaccttgagctggacgtacgcctcaaaacagacggcgatggcacgctcaaccgtggccggggttgctggacctcccttacccgacgtgataatggtgacgtacatcttggacaggcgcttcttgatggtgtgcaccgtcgtctcagtaatgatcgtctcggtggtcttggtagtggttgtcttcgtaagcacctcctcgtaaatcttgacagactcgtggtaatggctctcatgcttctcacagatcttggcgagggtaatcagcgccagcaggacagccttggagttggagtcgcctccggagatcaccgtcacaacctccttgtactggaccgtcacctgatagagaactgagaattcaaccttggcatggaactcgagcacataggcgtacttttcgtaaatctcggagatgacctcaatctccaagtggctgcacttctcgcgatggtgcagaattgtctcccacaccacgccgcaaatctctcgcagaccagtccacatcttgcgcgtgtggtagtggcggcagaggaagagggcagccttgacagcatcttggtggcagtacttgatccccttgttcaagatcgtgacgatttcgagatattgcttgtaggcatctgtgtggtgtccgagcatctcgtgctgagcggcaagtttgtacatcagctggattgtcaagtggccgttgtgtccatgctgcttgcgatacacctccaagacctcgacataaatctggatcactctctcatgtcggtgaagtccttcgtagaaatcaatgagcgcttgaatagcctccgtagtgtatgcctgatcgatcttgccgatggactggagacaagcgtagtagatttggaggtaggtctgctcagcttgctccaaaaggccctggcgatggtagcagagtgcaaggcggcgagccacaacgatggactccttggtcgagctctggctgagactaatcttgatgtcggcgctcagcatcgccttccaggaaatctcgagggtcctcttgatgatgacctcggcctcggaccaattctcattctggatataaagcccaatcaccgccaggcatgccgagaagaattcgcgatccacagtcgtggtcttgcatcgtgtgtattggagttcaaaaatctccctcacaactgtctcggtcacctcagtagtagtaatcttggttgtcttcttcgtgattgtggtctcagtgatttcttcaacgacttgggtgatgaggacagttgtgcgttgagcctcctcgctcttagtcttgcccttgctcttgaaccacccccaaactttggtcaggatcgaggcagagatggtcagaagtccaaaggacctgcaaacagttccgatctcgcgaagccagatgatcagaatctcggactcaaaggtgtgatgctcatattcagcccagaggcatatcaaaatattgctagcctctacagagcgatcgaccttgcgtaagaacttgacatactcgagggcaatctggatcttggcaatgtgaacctcaatgcgcgcaccggcagtgcacatggccgacacgcggcgccagaggctgacgtagagtcgctcggcgaggaagagctttccgcatgagatgtacgactgagcaaggcgaatcatcatggagatgcatagctggtcagtcacttccatgtcgtcgttcgtctcaaaaatgagcacctctagctccttcgtgtccttggcggcatcctcgcccttgagaacaacgtccagagtaccaaagacgttaccaatctgtcgagccttggttgacttcttgccatggcgaacgatgacaatctcatacagctcccggtagacaatagtggcattctgcacttctttgatctcgacatagagcttggcgagagcctcgtaccagaaaatcacctggtcactactctgcccatgcttctgcttgcagatcttgatcatgacacggatcatctcctcgcgataagtgacaatctccgttcgctgtgtaatgaccaaagtctctgtccaggacaggaagaggcttgtgcaggctgcaacaatagcgctgtactcggatagcacgacctgaccaagcctgacagctcgcaccaagtatgtggcgccgccatgagtggaagagacggagattctgcggtggacatggcccagggtgatgaggccttggagcacggagaggtgcttctcgccaaatgtggtctctctgatcttgagcgcaagctcgtggacaccaaccacatcctggtgcgtatagagtcggtcccagcaggtcctttccaggagcgagaaggtgacggtatgagggaatagatctgaaaaccccttgggaagagtaatctcgccgccagtgccaaccagacctgctgctttgaagtgcacagtccagttttgcaccacatatagaagtagatgatgggatccaagcagcttttccacaaccgactcatctaaatcatcaatcaaaggttctcggtcactctcaaggtggagcctggcatagagaagaagtttcgaagcaagctgcaagtgggcttcccgaaccgacagcaaggtgtggcccatctgctcctggaggaaggagaggaccaaggagctgcggaagtgcaggcggccgccgtgaaggacgaccacgtcgccgcacttctcggggataaacttgatgaggtctagtgtctgcttctccatctctcgcttagtcgtgttagtcgccagaagctcggcagcctcttgaatcgtcagaggacgcctggcaacaaccatgaaggacaagaggtggcgcagagtatcatccttgaggcgggtgtggccgacgagagctggcagtagcttcttcacatccgagctgatgttatgcttaaccgtcgtgtagctctcgagcgtggcactctggaggaggcgcccggcgaagaaggcccaaaggaaattgccctttgacttctctgcgagctcatcgacaagggcttccctggcgccaacatcaagcttactttggaagtactctaccttggagagattttcccagagatgagctttaatatcttccttgacctcttgctgggtgattacgatgtgcttgcagccatcactgaggtgggagacaggtcgtgagaaagtaatcacacggacatgggaaagcttagaggcgctggtgcgcagggtagtgtggaatgcgatctcatcgcagccatcgacgatgatgacgatggttgcccccccgcgttcagcggcttgaagaccacttcggaatgccttccatagagaagcctcaagttgttgggtagactggtgagcagcgaattcttcaaaagcatgcaccaattgagcaaagagagcaacatcgcccacactgcgatccaagagttgattgatcaggctcttgatacaagcaagggagttggcatccactggcgagtcgaatgctgaagaatgaaaatctgattagtagtgcaatcaacagagcggtagagtagaatgtaaatcttacggaaggtgtagtcaagaacaatgtaatgcttctggtcaagtggacgagtgagacgctcctgaacccactcagccagtatcgacttgcccgaaccagcggggccagtgacactgagaacctgctcattgctgttgaagaactgcacgatctcatgcttgatccagtagcacgtgtcttcggaccgctcaaggctctcgagaacctcgtcgtagagggtacctcgaacggaggacacctcagtgggcgactggagcttagccctgagagccgggacagtgaaggcgaagcgcttgcgtcccaacttggatgtccagatgtggtcttggagctgctccttgccgtcccaaatggcggtgatctgctttccaaaagtggtgtcaaaattgatcttgaccttggcaccagagcggtaggcagtgatcttctcgcggtagtgaatggcgatgctgccagtcaagccgaccaagtcacagaacagggaggcggcgtcctccttgatgacagggggcatgtgctccaaaccccggatctgtccgacggtgcacagaagcatagcgagctcatacagagctatgaatgtgggcaacagtgcttgagcttggccatggccgagctatcatgatacatatgtcagtccaattgaaattgttggcttagggtcattgatgaaaagcaatactaacctcgagaaggatctggcaactggccagcgccgcggccgcagagtcctttgcgccagggacaaaggcgttgatcttgtctccaaaagaccagatctgcaggccgaagaactgggcagctcccagaacacggtcccagtcactgccccgacggggcatatggatgagtcgttcatcagatatgtattggaggtagacgtgcaggtcagtctccctgacgaaggactcgtcgtattcatcaatgcggacaatcttcttcgtcacacttttaaacacatctttgacccggtggaagtagtccaaagatttaactttgttgtttgcccctaaggagccgttcgtgtctccgtcggccaaggagggcgccgtgatgtcggtcgcaaaggtttggtccccctctgcatcatcgtctgagatggagggactggcctcattgacgctgactacggcacgttcatgagtcttattatggctttttccggtgatggagtcggacaagccgcggatggcctccattgcgctgctgcggggaggggttcggggaggatgttcttcgacggtgtctgacttgacagaagggttggagttattacgtctgcgtcttcctgtaaagtaatgtttagcgagtactaaggtttttggaagtctattgaataaagaaaatagtcgagagacatactgttaatgctgttgcgtatacctatcatgctcgctccaaggcgccgcagcttggtgcctcatgagttggtgtgaaaagaaaattcaagggcaaggtactaggaagaaattgagaaacttttgataatgagaagatccattgagaggaacgagggctttatagctcaaatattcggcataacgcgacatatcagccccagccggcaaggagccaggcagagatgtgctgttgctgctagatgtcacatcggactaaccgaagcggatgagcccaacgacgccctcagccatcaaataacccttgctatgcggttccgctctatccagtctcagatgttgatgtgtcgttgaagcatggttctaggtcgaactctgatattggtcgagaccaaaaccgcaagccacggcgcctcgagtgagctggactgagcccgaataggtaatgattctaggcagtagagagctcaatctgcaagtcaatgcgacgtacgcattcgaaggccaccaatagcaagcgtgcggtacgatttgcgccggcccgcccgaccctgaatctcccagcttgcaagccgtggttgcactatcggttcccatatttggcacgaagggtgtcatgcagagcagctggggctaaccttgtccagctcccggtcaacaactgggctctctgcacgaaagcacattgaggcctctccaatgcgggggttgatggaggcggaccgtatgtgatattggaccagggtcgctttcttgcatctggtggctgctcagctcatgccatgaagctccatttgccaatagaggacagaccgggtccaggcctcctgctgccaagccccccgtcaatactcttttcttttcctgagggcgtgggttcagctcgaagtgatatgaaacaggcaggatagtctcgccattttaagcctacttcccgctcggaatgcaaggccagaccccaaaacggcttcaccggcagcagtcttgggcggggaacgatgatcttggctatatattgccaggcagtgcgcgcgcgtcaatatgaagtagtatcagccacacacaatagctcagccaaaatacgagcacttgcagcctcgaccaatctttcatctgatgaggatttccagaggacgctccagtccgagcttcattactggcgcgtatgtgcctttgacatgcgttgacagctatcgccgactccagcgttgcattatgcccggtgctttggcctccatgcatccaatactcacccgcacgataaccccattgaaattgacaggcagagccagatctcatgcgattgcctttatccccacagaatagatgggccctcgcctgatctctggctcatacgcagaacccttcccgcatatgcttcaacacaattcccagccaacaagccagctagacgagtataagcgcgaaaagtgaaagatgcagcatcattgtctcccggccgccgatgggggcattatcatttaaagctgccgatctggagcctccgcgattgcattgcattgacgcagtcggcatagtgaaattcataaaaagctccttgaatttagagatcttttgtcaaaccaagctcagccgcagacctgacttgtggcaaaaaggtgaataaaagaaaagaaagctaaagtcaatagcgggaaaatatgtcaaaacaaggtaaagaggtgtgagatcagtagatctaaccctctattcaaccctcaccgcggacgtcatcacgttggttcaattattgatcgaactgctagcctgacggggtcactcacctctttacgcaatactcgatacatcctcttcgctgcagccgcccttgatccgtcgatcgccagatagaaagcattaccatcgtatccgtttagcccatcatgggaaatgcagtcgttgtggatcgccatgctatcgtccccatcgtgcaatgcctcatgatcctgtgggcaccagatggccactccgattccacgggacgtggtcgagtcgatgacttgcatgctgtcttgctcattctctctcccctgtcctggcagaatgggtcattctacaaggattttgtcagtagccctgcgtgcgcgatgacaaacgaatcgggagctttttgtgtgacccaaatgccactgagtctttgatacgatagcacatcccttgagataacgggtgcgtttcgggagctgtaggccgtcgagcctactaatcggagctttggagtcgtcttcggcaataatgttgtactatgaagaagttgttcaagaggggcaatacgctgtacgcaaccatctcagatctaccaccgccacatctgttctatccccacgaagccagcagtgggtaaggctgtatgctgttgtcgcattgaagcatttagaagcctgcatctctgtcgctctagctgcgtatgccacggacgatcctccaagcgaaaagactgtgagctggccatgtctgaatgcgatcatgtcaggaatatgaagctgtctatgcaatggaacagtccgactcggagcatgagcaatggccgatatcattgatactttatagccgaccatgcaacacaaccgagcgggccgggtctgcgagcagaggagatgatattctcaagcctaaggtttcacatcaagggttgtcagatcggctcagatcggctcagatctccgagtaggtagcttaactagtctttcctaaagggaatcgcgggaaatctacagttagcagtgtcacgatggccacggaagtcagctgaaacatagaaaccggctgcggccatgattctgcccacaacaagatgatcgtcgattctcgctggaacacggtttgcgctccaaccaatagcctcatgacagactacaaacgagagtaattccgtctgataatatcactcgcctccgtcctcaattcggagacaatctcaccagcgtcctttaccgaatggatcaatccgatggaggcacccgcataggtggccagtctaccctcggggccccatccagcatcaccctccttcgtcgcctcggcatacagcctcttcagctcttcaaagcccacgccagcctggtgatcatgccaactccggttgagaataccccgcgggctgtaaccctccggccagcccgtcgtgccccgtagctgattgtacagcatagtgcgagtcgtcgacttcgcgccgtccgtagcccgcacaacttcctgctgatatcccttgctgatccgggcctcggtcgacgccagaaaccgtgtgccgaggacgaccccgtccgcccccagggccagcgccgcggcaacacctcgcccatccgcgatacctccggcggcgacgaggccgattccgctgctgtcccctccgagcgcgtcggcgatctcggggaatagagttatgatgcccagtccgtcgttcgctctcccgtggccacccgcctcggccccctgcacgacgatgacgtcgggacgagtcttgccctggagaatatccagcgcttcttggagggttcctatctggatccaaatctgtgtgtcgggcgaggcttcccggaggcggctggtccaagtgtccaaatctgcctgaccgtcccttggggcaaagagccacgccgcacatggacgatactccttgacagcctgggcggcagagtccacatcgccgtcccagagttgaaagccgatccccacgggaagcagagacttggaagacacgaagctcgccgggaggctagacggcggggcgtctttcacgaggccacggagagtggcgaggtcagtatggatgtctgccggtttggcaccgggtccgataaagccgagacctccagatttggagatggccagggcgagattgggcccgctcatcaccctcatcggggcaccgatgatgaagggcgtggacgcccatgggaatttggagacaaggctcctggcgcgtgtgctgctcatctaatgagagacggttgtcaggaatgcacaagtcttgatttgcccagatcttgacctaccctatatctgagcttttcctcaatgtcaaatgcgtaccaataaagcttgttgctgcttcaattagcagcaaaaaaagaacgtataatcattttatagtttcctcgacccaggaggaattggcgatcatcatcacgtcactgattcgattttagatcagagctatgcggctatgacgggaacggcggaaaggagggagtgacggcggggtcatgccgccacagatcagatctgtgctgggctcaatggcgcagcgacctccaagccccgaaaacaccgccgtgtcggaagcgtccagccattttcaccccgccatgtgttgtgtatgttaataggagctatcaacgctgcaaattgtgcttgcaatctgccaatagcaatgccaacggcgtggagcgtatggaaatgctatcattgaacactttcagattgatatctcgacacgtgatataagcacttgctattcatcaaaaggcatgtaattcgcggtcccccaccagcaacaggggacagataacatataaatcaccaccaatctcaccatcatcaagagatcactactagaaaacattcactactcgtcgccattgatttcatccatcacataatcatgtctcacccgtacttctcccacgcctctctcgggctctctctgatccccaccttctttggcctcaacatgctcttccggccaggcccaacgctcgagtccgtcaaattcccagtgccagcggaccccgagggcaagaagacagcgcactcagtcatgcactttctcggcgcccgaaacatcgccgtcagctacctcctcgtcctcatctggtccaggggggacagcaggctcactgccaagtccctcgtcgcctgcctctggatcgccggcatggacggcttcatccagcgcgcgcggaccggggagggccaatggacgcactggggcctcgtccccgtcgtgggtggtgtggcagcaggtctgatgggctggttaaactagagttagattaaaaaaaccgcccagatctgcgaccccgggtcaattgacgcgacccatgctttgtcccaccggtggtacgcggggaagagaaaggagtttgcattgatggtgagaccatcggatcggattgggggcccgtgatgggggaggaccggcccaagccttattcatacgttatataacctgttgatgggacatgacacaaccccgcggtagttttcgtgctgtttcagccagcccaaaagatgaaatgtcaatggccagcgcatgttgggtgtctatgcgcccaaaagcaccttgcatccaaagttcccatctcctcttgtgcccgtattacgtgaatgagtaagacagagacaaatcttgcatgcctctggaaccttcttgtcaagatttctggcttctggacgccggggaacggagcccacaagcccatcgcaaagtcctagaaacgcaccattgattctccacagccagtagctctctgtgaaggatgccggtggagaagatagagtgagtagaaacctctcaatgactcgaaggaggttattacttttggatcactaagcaccttccagaagggttcctcaaaaatcgaaactgcggccctcgggcggaggaatgactcgagactagtcgctgtttctcaacggccaactttttctcggaaatggcatacatgtccgggctccggaatgactcgatgaggtcgactcgaggcatcgagcttgaccggttagactagacaagcattccagcaagctatcttggtccgttccctccggctccccgcgtccgccaagaagatatccgctgtgctaagcagtgtttccccagtcgatcaatccagattcgatccgattccacttgacgcgaccctcatgattgaattgcaaccacacgggagactgctggcaggttgtgagtgtatcctgctgcatccagaccggtgatatgcagccgcaagccaaaggatcgggcagctgtctgtctcacagctaaaacagcatgaaatgcaagcacccgagatatgaggctttttttccctgtgccctcccctttgctttgtcaggaacaaggtttttttcattccgacatgttgtgtgaaatagagttcaagccacgctgccacccaccatctcttgccatcaatgccatcgatcgcggcggcgcatcggagccgcgtccgagacaggttaaagaggcagaatgcgtttttttccttgtccctccctcaacaaccacttgtcatgagctgtggaaagtaaagtgggcgccgccttggtcggtgggctaatgtcagggccaaagctgccaaagggcaacatccatcccaaccttgacgccgtctccacttgtcctactgcacgggcaaactctgaaccggggcaagtttttggcttggggcagtcatcaagagagggtgtcaagttgtgtgcctctgcgccgcgtgtgtgcgtgccccgtcctgccccgtctgccgcgtgttgcccatgtcccggcacgcagcaggacgaagctgcaggcaggtctgagacgggggaccgatcccctggtcggtgctgtgcgcatgcctcagtggacggggagcgatcagggggcttcgtggaggacgtatgtatgtttcaacgcacgttcagaccatcctgcgtttccagaaccctccagtcagagcagacaacgttgcaagctgggacaaagaaaaaaaaaatgaataagagttttgcgaaccgagctcctgtgctattgccaaatcgagcaatgtattttgggcctgagcacgtttccaccaatggacatacacatgctccatctgacaaaccggaactccaacgccgatcgattcaagagttgctttgatcgacctccagaatcaaaagaggaaaggtgctctctgctacggcaaagtgcaccattggctgcttcccaggagaaaacgcctcatcgggacgctcacccttggtagcggtaacgtaacgcactacgcaacgaatcagggagaaccatgtcgtagtcaagagacgccgtggcctgcggaggatttgtaagttggttgtctgcttgaaactacaacttctgcttccatcggcatgagtaagatatctcgcggctcaggaaatcttccgacttgatgtgagctcacgtcttcccttcccgcactataagccaatgcaccacatatgtatcccaaacccattcagtatctgcaccttgctcagaagatccggacgatcgtcgcctgggccaatgcaagcatgtggccggcccgcacgcggcaacacctgaatgtgcccgccctccttgaaaccaggcacaacaatgtccacaccacaccatgtttccggaccattccaaaaaggagcatcttcgggcccccgaggcgcttcctagtcgctggtggcttatatagtttttctcccgaatattctcccttctcacttcccattttttctcttctagtgcctggttttgccgaaaaggatgcatctgatttgtcgggcaaggttcctggccctcaggtaccagcaaccgcgtggccaccacactcaaaaagaaatctttgtccgaatgtacctgtgctagccgtgttaggctttgccattgcattctgtccctgccaatcgaaaccttggccgggtcgtgccgtgcaaggaaaggtacaggaaccatgcaggcgcacacacagctcaaacgctcgctctattcccgatacaccactcacacaccatccgagaagcccaaccgcggccttcatccgaactgcggactttactacaggatcacagtccggtggagtaccatggtacttgtagttggcagctgtggatgtgagatagatctgtacgagtgacagctcgcccagcatgtcctcccatctcggaatcctgtatataaacccctcgatgatccccccgttgagattcccttttcttctcatcatccaacagttcaatcattccctcacccaaacaaacctttccaacaagcctccggcaggtcttacacattcccttctcgaagaagccaacaaagctcactctcactaccaccaacaacttcaaaaaccttctctttcaccccaaaaccactttcaagatgctcttcaccaccctcattgccgccctccccctggccctcgctgcccccgtcgagcagctcgcctcccgctcctccggcaccgcaacctactacaaccccggtgttggcatggccgcctgcgacggcgtcgtccaccctgacgacaccctcgtcgccgccgtctccatgagctacgacacctccgtcgtctgcaaccaaaaggtcaccgtcacgggacccgccggctccgtcgtcgtcaccgtcgtcgaccgctgccaggcctgcgacgccacccacatcgacctctcccccgccgccttccaggccgccgtgggcgacctcggcgtcggcaagtctaccgttgactgggccctgtaaagcacccagcggtcaaacaaaccccttactaccttctctcttggcaaatagatgaacagcgttctctgtttcccattcattcccccctttttttttgagccttctgcaactttcctctttgccccttcattagcatcaatacccactctacttccacccggggtggaagtggaaaagaagggaaaagtggcagggctctctgtcgaacaatcactcagaattgtcaagaacaattcagctggatcggaaccgggacttcatctctcacgtgccatgggccttcctttgtttctttcatgacgaaccaagcatgaaaagacaaggaacacgattctctcctttttcaagacctgtcaaatagaaataccaaaatagcattggaaactactcctggttgaggaaatacaaacaaatgatttttgaaatacgccgttgctcctatcctgtgaagtgattctgccagtcgatctattcttcagcttcccaaaaccccaagtgccaatacacaaacaaaagccatccagatgcccagtaccccaaacaccaccttgcacgcttggtcaagtacccaatagcctgaccccccaagaacagaggaaatgaaagttgagaggggggaatgacacgcccttgcttttttgttcaaatgagtgaaaaataaagattatgaataggaaaagtcaaatgccacacagctggtgtgcctttgtcgtagtaatcgccgcccattctcggtgcgcggtacggaagcagaaagcctctgccatcatagacttttccttattagtttagtagtgttagggcgagcggcccaacttgcaccaacgttggtaacgtggtttgtgtgggtcagtccaacacaatgacacttcagacgccacttcagccagctctccctgtctcaagccaggagtcacctttcgttggtcggttgaatgcattgtgctctctttctagtttcaaagagaaaaccatcgatcccgacgcagcccctagctggtcctcactttcaggttacctgcacgaccgaatccaggcagccactttctcctagcgcctgtagctgagcctgagggcaggttgcctgcctcagattgctgggaggaatcaaaagcgccttgcgggataggctgaatttcagtcacagtgggtgactggatctcgccctttccattctgatttacacacctgtacccatctccgtctagcccaggaccctgaacatgtcggtcttcacgggcgattggtggcggtgtcgctcccgaacggtcatcgtccagcaatgcgacgttccggctcacactcgtctgcgtctgaggcgcattgggcacatccctggctggcatttcactgttgtcaggaatggggccatcagctgggggcaatgaagcaccagcgccaaatgatcgcctccaaagtcgagtaagcccattccgagcaccatgctgtcccgcaatgggaggatattgagtctgctgccgtttctggctgcagttgggagactgcttcggtggctggaagaactgagcctggactggggtcttcataccagccctcatttgggcatcgtcgctgtttcttctcgcatgacgagggcgacggccaaaaaatttctgtacagcttcatgttgacttggtttctgttcttgctccgccttgttgttgttctggccagcgcgagcctgcaggctggatcgtctgttgggaggtgaaggtgggcctgttccaaagagcgcctgctggactgagaacaattcttccaactgtttcccattgacaggatgcccttccggctttgggtcattgccatggcccatgatagcattcattccccagctacccattgaggagccgcctgggaaaccgaacatgtctggagaacctctgtcatctgcttgggcctttccgccacctgctcgtagccaaatgtccaagctagactcgaaggtgttttcggtgtcagcgctatccatcgaccacctatgctcccgcctgtgggatacagtcgactcatctgctgaccgggggcgttggatttcgcgagcaaggtggctccatgggtcactagtatgaactacgggtgacttgtgagactgtttatgactgtgagcaggcttaacaactacaggggagctgctcatcggcgttacacccttgctgtctgcagcttccatcggatacccgttgcgttctgaaccaccactaaagcttcgattgccaagcgtgtcattcgaatgcttcatacgattgagagttgcgctcgatatcgtatcaggagtcggcggcatgccagactcatgcaagctcacaccgccaggtgtatcagtgatcactctgcgcagagcctccctcttcgtttccagagtagcccgacgaccgagtgacggcgcaactttagtgccgtcggacgtcggcggcggcttcattgcgcggttagtgggttggggagtttgtctcctgggggagtacgctgggtccatcttttcgatcttctgcaacggtgagccacccatgaggcttgctatcggctgaaactggctggacccgtgcattcgcgaggctgggctctctgtgcgggaatcaaccggccgagcctcaccagtgactctcaaacggcccaggctatcttgctttcccatatcatgcgacataccatcaagggaaagcggctcgtcgattgttgaagggagggtcagatcctgacctttctgaccgtagacactgacgaaggagctctcactcaggacgctcagtgtcgggctagacaagccattgattgggtcggtgtgcatgtctaatgcactttcgctcacgcgagggaggctgatgaggctgcctctagcaccgatatacacatttctgaggttttcggtgttctcgctctggtccgaaagaaagctgggcattcggttgatgcttctgccatcaaagtccatccatcgaggatcgataatctcgggtgcgggagcgagaccctgggaactatagtcaacatcaggagggctataaaggccctggggttcggcccgccgtcccaggtgagagttgcccttggtcaactcttcaatccttgcctccagtgtgacgatcatagcaacagcttcttccaccgccttgtcacgcttctcaacctcctccgccagtttattattcagctcctcggctgcgcatttttcagatcgcaaggtttccatgttctcttccagcatggtctgcctctctctgcggtggtatagctctaatttgaggtcgaagttttgcttgtgtaggctcgatacaacatgctccatctccttgatgccgagaccctttctggctgccggctccccgccagcaccagaattgggcctagaaatatcgagaccaacgctcctagtaggtgacttctggacgcccgacatcttatcaagcgagttgttcgactcattgttcattcgagacgaagccagcttttggctctctgattgacgctccttttggagccgctcgtggaggagggacgacactggggtctgccgggccggttcttttgggctatctcgggacagctgtcgggaggagggtctcggggagttgggggatctggagcacgaggcatggtagtagaggtgttgtgaatgggcactggtcgacatcttgggggaattggtgatgtgggtggtagaggagttggcgctctgggagagatgtcgggaattgcttgtgctggtagaggagcgggatgctgaacgagggtagggcggacgagatttctctcggggaagcgactgagctccgtccattgtggaatgctggaggtgtttgtgttattctcttgtgacaagccgatcaaacgactgggctgagggagggagtgccgagcatgcacagcatctcgacaaagtagccagtcgttgaattgcctgggcgaaggggctgtccagagctgatgcaatgattgaggccggcaagcaagcaaatacttccgggctgggggtgatgcaggttggattgaattgataggagagcaggagctgatcgaattccaggagttgtagggattgcgtacgttggttggcagggcggcagaggtgaactagtaggtcaggcgacgaagggacacaggcctcgtaggtagaggagatccatgcatgttatgttcggggacacatgggtttggtgagaaagacaggtcctcgctggatgggttccttcttggtcgtaccgtggttcacttgtgccctgagctgtgctgaagctggcgggctgcggcaggggtttagtgccaaagaggtaagcacggtacaaggaaggcagtaagctcctccctctgcctctgctgcggtagcgcacggacagcccaaaaaattggctgtggggcggccgtgattgttcgtgagatcatgcagcttgggttcatgtcctcagtccacagctctcagcgcagcttgacccacggttgggcgatcaacgaacgccagtagtcaggaacggccagcattcctccgacgcatggcctcccgccggcttgctcgcccattctggtttgcaacaatctccattcgctcagtcccgacagccacagaaggcctcgtgcggtggggttcgctttcgtttctttttctctggctttgacgtctcgccacggttgataccttattaggtgccgtgcctagagctagacaacatctgggacctgaaacgaccggccaaactgtacctcgctgctaggccgtggggaaggctacatcacaatgggtgggccacggggatctgcccctgatccgagtgtccaatggcctgggcttccgacccagtggactgcaaggaaatcctagcagccggatgtactcccgcccgtctgtcacaggactgagagcaagagacacacatggaacagttcccagcggttacgccgctgtgatgggcttgctgattcgccacggcaggcgagggtgagattggtgttgccagcggcgacatataacccaattcctcatatcatggcaccggcggccaaccaacatccagtctgtgtgattgcgaagggctacctgcatatgcatcattacagcccaccctctttccccctttccacctgcgaacgaaggagcaagccaaacgattgtttgcgttttgcctggtgggggttggctgtgcacccctgcattgattgcactgcgtccgttggtggggatagatcaaccaactggctccctggatttgttcctgtccacagactatcgccatcaatagtcaggcagactctgctgcttgtccctgtcgcagcgttgctttagatccggaacagccaaacggtccgtcgcgtaccgcaccccgccaatagcagcgcaaagccgcccgccgccgtgagttgaagtctgttcacgaacgacttacagccgatgcgttggcttcgtccatgttccgccaacggcagcctcccgtcttcaccgttcggcctttttcccagctctgttccaaaagacactcttctttttgtctttgtctcaacctcccctacccggtactgaacagccactgtagacagagaacatcggaccgagcgccctcctctatcgacccttgaccgccaccccctcaattacgtattcccacttgcagtagcatatcccttcgataaggtagaaaaagaaaagagaagaaagaaaaggccattgacgcgaaacgcgttaaaaaaaaaaaacgttcgcgtcgcgctaattaaaacccttgtcgaatgtgctgctagttgataagtgacaatctcattgtcaccaccctcgttaaattgaaattgcctactttctttaagtgcttgcatccttcagcggcgtctcttggctggatctcgaccgtggaggaggctaccatgacgcagatttcgagtctcatctcgattttacacgcgggtcgcacattcgtatccctgcagacctcgttcgccctgcttccaactgagactgggccctgacaccttcaatgatgaagttgtctgatcggccaccagcctcatctcgatcttgccggtagaaatgccacggctgtgtaccccaacatgccggcggatcggcttcaaggtttaactcggccaatctgctgtttgaccggtacgtcctggacaggacggccttccaatcaccacaaataacccataaggactagctctcacgtaaacccctgtttacaagctcttacagacaccatctgtgaaccaattctttcgtttgcccgaatgataacacattgtgcttgaaggcaatggtctcgtccctgtcggcgttgtgtttgtgtaacgtactcctgcttcaaacaacttcatgttgcacaaaacccagcagtcaggcctcgtggcatcacacaagggtatcacaaaatgctgacctttctgcacctccactcaccttatcaaaacctcattcatggactgatgattctgagattgagggggagccttccgaaagagcgcagagctgcagctgtacgcgtcccgtagagagtgccgttaagcaatagaagatgaagcccaagactcgcggtgcgatcaacatgctttcgtagactgtcttacaataatacaaattctaccagggctattgttccagctcttctcggtgccaccttggaatgttggaccgggaaatctccgaatttacaacaggaaagcattacgctcacacgtaactctgccgataaacttgccagcagtgaattcagtacatgtgcagctggttatttcgtttctctcgctgattaccgcacggaagtgtgcaaagcggcaagtgctaatcccccacagtcgcttgtgaatgcgaagttaggcttcctattgcgtcctctgcatttctcccatcgttcagtcttattacgcttctttcacatatttacaaatcttcagttagaaaggttcctacagtccgttttggacaattcgggaagcagtctggtacctatccactcagcttttgggactcaagtcatggccttttcgaatgccgttatcccatctggggatactacctaggcggtgcgatccttaggtccaaacccttcgtcatcattcccatgctcgacaataaccagcttgactatcagtgacgccccttataggaagagtctattttcatataatgtgattgttaacgcctcaacatgcagaattatgtctgttctgagtgtctccgttctgtttcctcaggtgttaccaactccattggcacagcatgtggtcagatcttatgaattcggtcagtgaaatgtgcaagtcgagttgaaacacatcatcggtgttagagcccgaaagccctccgtattggaaataaacgatgctgttgaggggagaggtctttacgaagcccagctgccaactgtcgtcggcaaggctatgcccgtatccgcgcgtcgggaccagacctggaattccaaacagtgagcaaacgaaccttccaagttcaatagtttgtgcggcaaaagctatggtcaatcctacggcttgtaggtttcgttgcgcgggaaggccaagtctacttcgagaatgcccgagttgctcctcgccatgggggggatactgcataataggcggcaccaccactagaccagcgcggccgatcgatacggggaggaaggcatgttttattatatgtctctcagtgcctctgattttaatgaaggtgcaaagtgtcaaagctaggtagactttcatcctgagaggccgtggtgttgggcccaaatcaacaaggtcatggattggggagcgaattgccttctacccaaagctctctgaccatgggctggggacacaggagtactgagacaacctaaacaatgggggcattatggctcttcttccccagaggggcaagtacatcaccatcaacagctgaacgaggaagagtttgcaaagcaatgaccataaagtaagcaatgataaacctatatgtggttccctgtccacctcaaacgccgttcatgaatgccaagaaaccaataacgaaaagagtccgctcactacactctacagctcgtccttaaaaaacttctccttgctaccctcctccttcttgcgaggcttgtccgctctgttgggggtgtttcccttggacttgccagactgatcagactccttggtcacaggcttctcatcctcgtcgtcggactcgtcttcggcttcttcaacactgtccacgtagccccgtaactctcggatgttttcgtttgggagctccacaatctccagcctccaacccaaatctccagcgatcctctccatctcagcccgcatctcttcaacatccttgagatccacctccatcctctccaggtcctcccgagtcctcatctcaactttaccgccgttagccttactagcagcttgggcaatcaggtcaatcagggcctcggtgtctaactcatctcctttgaagtagttcttaggcgtgttcagcttcatgggcggctgaccagcctcgtcggctccagagagaaggttgcgtgcaccaacaaccacgccaccaataaccacaccttgcttgttcgatgcaccaggttgcaagggttgttggttggctggcgtccgttcctcgtcaatgtcggggacagtattctgcgaattctgctttgtcccctcgaggagtggcgggttggcaccctccggtagaacaagttggcagttgataggatgagcttttgcttcctgtggtggcaggaacgccacatcctggcagagctgcggggtgttaaccaccatcagataggcacagatcgtgacttccttaatccatgaaattctagcttgcttgagtccggggacgcaatgatattggacctcaattgttcgtgctctacccgtcaggtcgcaaatcgtgcccccctctagcttctgtaccaggtatcgctgatcgcccttcacctgcacctcggcaggtagcgggttcgcttcggtgctcttccggctcttctgtaatgatgtcgatgggatcgcaggagtagctccaaggatgaattcggcagtctgtggatctctctgcggcggctggttgggccctgtggcggcggcagcatgaaactgcacgatttccgtgttctgacagaacttgtagctccaccaccccgacatgaagtagagacaagaatctcccaagtcactcaagagctcccagccgttaactgtggcccgactcaattcctgcgcttcctcagcccttgctttctccaattcatgtgctgtctggttttccgggatcgtaggttgtaagacggggatcgagcacaagtactggtgcggggggatcttcattatctggtatgatcgttccgtaacatcctgctcatcagcgccttgaccttggtgaggggtcgatttggcgaggtcggtagagatagtcggctgcgaagcgggattatcattgaggagggcttgcgcctccttctctgatatccatttatcgtcggaatacacaacttcgtactgcacacacagctgtcagcttcaaatgtgcccgaaaagacgttggggcagcaaggtcatacctgtgggaaagtcaagaggtcctcgtggacgttgaacccacgcgaccgagctgcgcatagctgcaagctagccagcaaaacgatctcgaggcgacgcatggtgccacggtctggctattcccgctgtcgcatagactccgcggctggatcttcggctggcttggatttatagtaataactacacacggggtggttgaacatgcattggcatgactgtccggaccttgtttgtggccaacaactccattgacctgccaaagtgtcatgtactcgctgtacgtaccgcggccgagctttagccgacttaaggcctgtcgccgcaggtcccaaataggaaacaccatcagaggtgcaacgtcattctttcccaattgccgatattaataagtcgaggagcttcatcttatcgagacatgactgacacgtgatttggttgaataatcttaaggtttgatgctgtttgtaaactttgtatgaacagttctagtttaggtccacctgtcaagccaaccatctttcttgcaatagcgagaagttgagcactgcttaagcctttccactagcgcaatcaaatgctaccgttcatcaagactcacccaactctcggccatattcgcaatacctaggtaggtattgacagcaaatatgccatacctcctatctctaccctacatacatattttcaattaatcgcttcccgcaatggagagcggactgtattatcaaccttcctctaaacaatccagagtatttctcatgcccccctcagcagtcttcaatagtcatatgttgaggatcacgaattgtgggatcacaagctaagaaattctaataaacagacctcttgttcggatattctgtgtaagacctgcagctcaatccaatcaatcctatacttcaaaaactcccgacactactgctgctctggtatattacttgactacactgggctaagcttaaggcggagcggcctagcagccgccacagctactgtggccgcgacctacgttgaggctattggttggcttacagccgtgtcgagacctgtgtcttcatccactccatcttggctgtagggccttgggccaggccaccgccacgaagattcagtcaatcgaactccttgcgaacaaaggctgtcaccatcttcttcggtgctggtatcttggtatctcccgtcttgctcttttaaaaagctgcttgcttattcagtgcctggtaacactaaagacatagccaaccagaaggacgagggagtgtgtcgcgcgaggcgtcaagctaccacagctgagcgttcaaattcccagcaaacgtggaaagaatgacgcgcggcctgcttttacctctccaaggccatttcaatacggttaatttcggcgatgtgcaggaagtaatgcgcctacagagctattgcggctagactctaccgcaccggggtgaactcagcccagcaatgggtcccgaacggtcaagaacggtcgggattcctggggctggagagaaactataggcaagtatgctagctgaaccttcacgcaagcaagaataagctcctgtataaatagaagtaggagaggtgcccgtctgacactgcagacacaattgttctcaatcggttgtaatccagaaaatcaagtttgtgcgcagagactccttaccacaatcatcgccttcaagatgcaatacaagattcttgccctcgctgccatagctgccacggctgcagcaggtgttccccatctcgccgctcggcagacggacatcaacccgtccgcctgtgcctcagctctcgggaccatcatcacggacttccctgctgttcctgacaatattgtctctgccaccgacatctccgtcggcaccgccaccgactcgtgcgccatcagctacccatccagcctgagcagcgcggtctccagcttcgcctccgaggtctcctcctggtactccaagaacaaggacaaggtggcgtccctgacctcggcatgcccagccctcggcgacaatgggatcagcatggaatttcaatgcgccagctccttcctggcccagcagacgtctgggagcagctccgccacggcgaccagctcatccggcagttctgccagcgctgctgccaccacttcaagcaagggcggcgccgcgcgggagacgggagcgttcatggccgccgccgcggccgtgggtgttgctgtgatggcattgtaaatgccaacgggtctgccgtctacctatactaaagagagctcacaatgaacatgacggaacaagtaccacgtcaaacggaaccaaggccgaagcaatgcctcgggatggtttatctcaacggcggcgttatgatatgaaaaaaggcattatgagaatttatggataattaattatatatagtgtggctctcggaacgagctgcattaatccatacatcgaagtctttctctatccaagatcatcgatgcccaacttcaaaaggtatggcaaatgtgattttgaagtaaatgaagtggacaatgggccagaggcaagtcaaataggccaaatagaatatagtgagccatgtgtctctcactccatgtgagtaccaaggtcagagcaatggggtattcaatttcgagcgacaagaagcaacaaccaaaagggatggcactacataaaagtcaccaaacgtcgccacatcacggtaatccctaaatgatttctcatatagcatatgtctttttcgtttatatcagcccaaagtgactgcgtcatctctcaatatcgcctgcgtccatacttggtatcacgccattcaggcaatagatcgctaatgagaaagacattaggtcaattttatttgtaatttatctcattgttaataaccctagacatcgtatcttttaaacttttcagtgaaggaagaatgccagaactacagcttcaagggcacgacactgattccttttgggactctacctaccctattgttcggctagatgctgtcccatcgcttatcccaacagtggttgtgagtttgtagtcgtatgtttttactatcctagtcaattgagaggtaatctctccttcacatcctgctaggatcaatagccaccatgagcccaaccacctgcaggatacttttttcctgtcatgtgtgccaacgagagttgcagtgccacgtccgagccagccagccttccatactaccacctaccctgaaccggaaagtatcaattgccaacaaggacaccatcatagacatatcgaagagccgaaggcgacccaaccgagtcctagatccacgtccgctgacaccctgccaggtgttaccgaacgggaagtcatgcatgaaagcaccgctgcaagaggctgaaaagcatcccgcttacttcgaccaaccagggaatggtttcgtgcatacgacatgtatgccagcctaagcgtcagagggagggtcagagatctcgtgagcttcacggcccaatggttctcttgctcccaatgccgcgccccggccagaatggaaaaggctgccgatgccttgctctgaccaccgaatgttgggcgtcgacgcgcacagcgtcgcagtgaggtttagcgcccatgcgacttacatgcatacttacatatgtacgtagttacggtacttacatgagcctgatattatgatacacatcgactgcgccggggtggaaaccccaaaagaaaaagaaaagaagtggtgagatgacgtggagatgtgataggatggaggatgtgggatggaggttggggaaagatgaaagttggttcccaagatcaatgatgacatctagctgtgcctcatccaccacgaactggttcgagatcaatatggcacagttcgtttaatcactgcattgacacagagcatgaaagccaaagagagatcttcctgatactaggtcggagtgttccgcctgggacggggaggacatactccggacagcgagcgctgcttgatctcacggtatgctccagggtcccgctattgtgtttgatattagtggatgctgtgcctacgatgccatgcggtgctctcaggagaatagtcgatcatatcggtgaggatcgtcaacaggactgtaggggggcagcagcaggggtctgacggagggatggtctgtgctgtgcaggagatgatgatgactcgattgttgctttcgtgtccttgcacagaaaagggaatggagggcagcaggggttgtagctcatcgtccgcctcactttttgaggcggttctattggccacggcccagttggcccccatggcgaggaacaaccattgcctactctaatctcgtgcattgcattgcaggcctgcaatgtgcaatactaatgcatcatccttctgtgtcgtcgcttctgggcggcagacgacacacaaatgcgccagtgtgccacccgtctcagacggcaggccacggccaataggagccatacacttttgcgcaaatgccttgaggacgcctagacctgcacatttccagacggctcggctgggttttggcatgagagaagagagatcgcgagaaactaagtgcgctgttgcatttcttgatggtcgccccccactactaccgcaggaccggtgagtttgtgggtggggagtttgtttctggtgtcgtagtttgtcaatgcgagccgataatcttgaggccgaggacggccccatactcggagatcagccatatgcaaaatgccaatcgttcgtgtaagagaagaagaagaagaagaagcaaaatggaaccaattacgtagtttctttcttctagaagcagagaaggataacaatgacggcaacactggcagcatatgcaaatggccgcaagttcgccgtttgtggcgttgggatagcaggtgcgactggtatgtgagtctgggatgggcggcacggtaaaaaggccaaagaggtgccgatagttcgaaaacaggactggatggtaagaatggcactttcggtatcctcccgtctcggttcgagatccaagccacgttggcccaatatcacacgcagccagcatgcacacaaacctgtcggtccccattgcagcactcttgtgttgtgtgtcagcagcgcttgacctggagcggtccgagggtgccgcagccactataacacgtttgttatttacctacgcgctaaatgtctggccatgcggtgttaggagccattagcacgaagcaggaggcccacggagacgtcatgtcagcagttagtctccagacaggtcagttcagtcgggcgctgatcacacctagactttgccgtctgggatgtgggcatgcacttctggccagcgcggcgtacatggagcgtcgggcgtgtactgtagcatttcgcttcgcatgcaggagggcgatggcaggtgagcggccggagagagctcgcctaccacgtagggacggtagcagcaggctgccgacttgcagcaatacctgtaacactgaactgaagacaatggatggatgccgtcccagcgtgggctctgctaacgtctagtgggtgtgtgagggcaacggacgctgttgtgaatggcagcggcggcggcgtctgagccattcagaaggtggagccgtcacacccccggcggcgggatgtgttgggctagctggctaccaatcatttggatttcgaggcggaagcgaccagggtgccagtgggatgccagtggcccacacaccggtatctcgagactccgggcagtagaatgcgcgctagctgtagtgggagctgtcgcgccagctcagctgaggttgggtgctgtcacaggcgcgggcgtgggagtggtagtgctggcagtggcttgcaaagtgcaccgaagctgggcacagccccccatcggccgtccactgtcccacccaattcgatgtggcattggctctgactggctgctactgagaactgattgattcaatgtcatgagatggccgagcgagccttagacagctcccgcaggtgagacggccacagagacccggcattccagtcagcagcccatcttcgtccgtccccattggcaggatgagctgatggccaagagactcggtatcgggctaccataatcttatccaactcgtatcgaatctggagctatgtcaccattttcatcggtcgaggtgcatgttacgtactaacccaagacgctagcccacccacccatcgccaggcttcatgcatgagcaaggttctccccgttcaacgagtggggattgacagcctcgtgcaatgagtggcagcccgtgctgaacattgctattaatctccctgttccgccatcttcgcgagtctcgactgcgttcacgatcctttcgtctctatccgactttctgtcctcgtcccatcaaatcattgccagacaggaccggaacagcaggatctctcttgccctcattcgacaaagatcccccagacggacccgctccacagtttcgaaaatccaaggcgacttccatccaagtactctcgttcttcgcctcgacttttctcttccacccatcgtgtctttcaaacccacattcttactcactgtttgcgacctcaccaccacatctactaccgcccgcacagtaccttcgctgtaacatatactccataatttctccagatctgcctgcccattctttgccacgcaacaatgggtgacgaaattgcgctgcttagaaaacagcttcaacaaagtcaagcagagaaccgtgccctcaagcatcagcatcttcagcttctgaggacccagtcccatgtgccggtctcctcacagctcaccaatgcaatccaccaaagccagagggtaaatcccctcgcccgtagccagtcgacaatgggctatagcaccgttagcgtacgtatttgcttcccctccatcatcgctcctccctgccaccgccctccattcttatgcgatcaccctcttacgccgacagcaggactatgccaaccaaagcccaaagggcgttgcgcgcctaaatcgggtatactcgcatcagtcgcctacctcgatgagcagagccgcatctgcccgcttcgagtccatgcccttccgcccaactggccctatctcaccgctcgaaagccagcccttgtaccgctctgcgtctgaccagtcccgcatgactcaccgttcgtcctctcaccagagcctcgccaatattcaggagaacgatgtgcttcctggcgtgggtgtaaaccccgcggaattcatcgccaactacccggaagacgagggcacctatctcgcaaccacaaggcctctggcacccaacgatatccagttctttcagaacgcctcggcatgcccctccatgtactctggtgtgacggctcacgacacgccaagccccatgtcaaggcagaacagcgccttcgaaaacggacagaattggggtgttgatatggtcaacacagtctcgtcacagtcaatgttcgccaccggctccgagcacatgctcttccccaatatgagcttcaatcaatcgtctgacggaagcccaaagcatcacccagcagccaaccaagatctcctgggccttggtgcgagcctgcaggatgcagcgccgttgtcatcgtatgcacccacgagctttgacactagcttgactagcgacctgtccgctgatctgtctactgagatggagcgcatcgactccaacgagagcgtctccagcaaccgctctagcgcatccaatttagagcggcgtgccaaggagcgtcatagacaggttctcgagaacagcaagagaggcatcgtccccaaaccacaggagtcggacgcctcgccacctgcgatcaagaagaagaacaaggttgcgcctaataagctcggctaccagcgtcgcaagcaaccccgtgtcttctgtacccagtgttccgagcaccctggtggtttcaggggcgaccacgagctacagcgtcatatcaatgccaagcactctatcgaagtaatcaaattcgtatgccgcgacccagccttagttggcctaaagtccaaagtgcagcccaaagcaccgcttaaaggctgcaagagctgtgaaaatggcaagcaatacggagcctattataatgccgcagcgcatctccgcagagctcactttgttcccaagctgtctcgtgggaaaaccaagagcgccgatgagaaacgaggaggcaaggccggcggaaactggcccccaatggacgacctgaagctctggtatgaaaagatcacggtcaccagtgggggcgcaaccgcatccccttcggacgaggccgaaagccccgaggatgagattgacgacatggacctcgaaacagaggatcctgagcctatgcctggtctccagaaccagccgagtggtctcgatggtgtcgctgctgccatgagcggtgtcactgctgagtggactggccttgttcaacctgagctctctctgcccgaatctcagggttatatgtcttttcctggacaaatcagcttggaaaactcaccagccaacctgtctttcactgaggacaactctcccccaatctgggaaaccacggcttccagctcattagcttcgccggctcccggctttctgggccaggagtcacctgccgtagccttcccggccttctaactctccaagagagaagtatgtgcctgaatttgatggtgatggcgacctggactctttgaagcttcgatgacccaatttgtgcgcactactacatcctgctatgggttgttctcatgttgaacatccgtacgggtgataaccggctgactcctgacgtgtgagaaaaaaattacaaaattcagcggcaaaaaaaaataatcattttcgtcaaacatgattttaccttttttttcatatttatttcaaccatatcaagcaatctttatcaggcaagaccatggtttgaagtacgggcatcttcagccttggcctgccatgctcattcgctcgaggctggaaaatgcactcatccggatggctgtgggcaaatatttctcttctctttcctcgactcttttttttgacatttttttcgtatcttctttgcgacctcgcgtttcgcttcgaccggcttgtttgttatggcttttgttttttcaatggtctttcatcatcatcatttcacaacacaattctttttttggtccgggggcgcatacgttttgcggtctcctcaacctgctgcgcacagttgaagggaacgctgtacaaaaccaacccacgttatattcaacctgctttcggacttgggaaagtcaactcgtttctttctcaagccgggatttcgcgggtacacatttttaattattcttcctctctcattttaatatggggatcacccagcctatttcaaccagagaggggaagggaagacagggaaatgactttatctacaatagagcggaacgagttatgacatgcgatctccccgggaaaagcgggcgatcgctaatgattattgatgttcgggggcatacagcagggtgtttggggcgtcgcaacagcatcattggaatccttttgggtcatgcgagcatggccctgacggctggctgcagagatgttgtcgttgtttgtttgttatttgattgggctgctttattctcttattgctcggattgttaattattctgcggacaaagcgtgtctgccctggggcggcaacgggtaacaggcgtttcatggctggagcgaaatacctgctctatgttgggtcggtggcggatttatgggtgtctacgcgatagataatgtttcaatcttggtgaggtgggaaatatatggccacggcaactgcataccgcagggtgctgatgtgatctgatctgtttacatatcgatatcccagttcagtctgtgattgtgacatgtgtatggaatcatgcctagctaagcaggatatagccgtcaattcaactcgatgtcagacttggatataatgatgatataaccccagaccagctctggttatctttgctcaagcccagtccttggcttgacctgttcattcgcatcgtcattgcggcgcagaaaggcagcattcgccagccttcacccaggatggaggtaaacgtgggcattcatcagcctcagcaacacacacgggccgacattggttgcctttttcgaaggagcagagagtctccctggtagtgccagagagcggctgtgtagtggagtggtcgatcctcctgtacaccagacggaatatgctgccctattgggtcgtctcagatgcatcgctgaccagttctgccgggaaggttcttgccggagggttccctgagcagcgccgcttttaaaaccccgccctgcctgagccggctgagcataacacctcagctttctaaaagcttatatatgcatatcttgagtctatagagcattgtacttaatcaatctccgaattgaacccctttctcaatatgcaaaatatatcttaggaattatatttgctccttctgatgccattgctacttggagtttttccaaccaaattccttagttcaggatcctattcatgtcttccctgaacggcgaaataaacagcacttttcaggtttcacttgaatttttcatgtcatgttagcggggcactatgggattggaaagagtgtgatgtaggtatgacgagttgggtctaatagggcgacgaaatgggccaagggaaggcgggaagtcaaagtcgaccaacatgactcttctgcagggcgtagggtcagacacggcggtccgacaccattggaaactgtcgtttcgatcgggaggcaccctgctcctgttggcgaatgctctatttggcgagtcaggtcaggtacattgcaggggcgggaagtgcactcggagataacttcaaggctctatcctatgccgtggcccgacatgctgcagttgtcatgttggaaggatccctccatttccctgaatcaagcttgttaatgtgttcgagggccaagtccagtctgccttggccttgtctaattggttgcgggtgctacaatgagacatggcaacgggtaatggttcacgggattggtcgttaaggcaggggcaacttgctccctcttcccattcaacgccaagctaggtagtccaggctcctttggaagcgctcgattataggtcatggcagataaaaacattctccgacccgacgcgtgagacagagaataacgtcgtgctgtggagtttgcccggaacatcctatgtgaggatgttacgtagtaggtatccaagacattgctcatctacaagaatcactatccttttgcatgccaggaggttctggaagctaagacggatgagaaattaaccgataatgtaaaacaggttgatacatcagcggtgtatgcgtgtgcacctccggagacaagaatacaaatataaaagggctggcccagtccaaaaccagctccaaactaaacaaaatctgtaataatccgactcatttcactctttgactttctccggcccccgtattctgcacgacaatgaagatcgccgttattctcgccactgtggccattgctaccgttgaggcagcgtggcaatgccggtgtgaaagccgcgacagtgtaaaggcaggcataaatgaaatttgccgccagctcaagtacgttttcccccactattgtcaatggcaaaccctcggagtagaattctaatgcgaacatgaaatcagctcgaattggacctctcgcgagtgtttcttgggactctacgggaactgccatctctgcacatatgacccggccggagactatgaccgggccagcaaggatcgactcgactcttggtgtatgtcaagcgaaagccctctttaatcatgccagtactgacaggtaaataggccgctcgcaatcatatgtttccaacaattttggaagcgccgacttttcaattcggtgctaccgtaagtaagtggctgacacttcacaacttgggttttcgggtgctggctctaggggcattaaggctggcaggatacaagtggagattgagctcgtatatctggaacatagacgcaatggcggtgctactacattgtgtgttggattaggtataaaggagggtgtaagtcaacatctctccgagcaccagctgagaaaatctacggtttgaacagccagaaattgccagatatggaaggcctaagcaggagtgtatttggctcataggacgtagtagatagtctattgagacagttccatttgcacaattgatatgtatgactctagctactaacgtgctgtcgcggcgtgactgagcaggccgctgagcaagagcggcgagggcgctagaatcaaaatagaagggccacactggacggaacatgctgccctatttggccgtctcagatgcatcgctgaccagttctacaggttagccgttggctgaggctgtggagaaaaggcggttcagccgtccactaatttaataatgatcggtttgccagattatctcagccctggaggaacgatgcggactggccgcctaaagatagaaataaggcctagcccagcatcgtccccggtagcggcgagcttaattgcccccgtggctcgcatctttcttaccctgttgaaatggaggggtctcacgctgtataaagacctcgacggccgtctcttttcttccctcccatgtgacattgcgagacgtagaacttctcttttaaaacagttctgcccccaattgcacacaggaaggagtgcagacactcgaaacctaggccagccaccatggccagcaacccaagaatcatcgtgcgacaggccaccatccttgtcgacggcaagagcagcagcgaaacccacagccgccgtcgcatcgccgccaaacaacacaatggaaacggtccgtccctgaaccagctcccggaggcgtgggacaccttcatagcagacatgacgggcatgcactccgtcgccgccctgcgcaggtccctcgtcgcgcacggccgcggccacggcgccgtctgcctcgtcgtcgccatcaccctcaaccacatgcgccggctgctcctcccctcggccacgcagttcttctggccccacgccctcgccgacatgaagctcgcgcgctcctcgccccaccgcctcctcgagcagtccgtcgtctctttcgactggctgcccctcgccgcctgggccgtcctggcctacctcctcgccatgctcccatcgctgctgggccagctcgtcaacgcccactgcgggcgcgggggtagtagtagtagggccacggccgccgcctgtattgtcgcctacgtcgccgccagcctcgcctgggccgagcacgcctacgtccagtcgtgctggacgctggcgcagctgtacgcctgctggaggctcgtctcccgcgggggggacgccgagcgggctttcctgcagaggctgctggaggagcagtccgcgcgggcgacggccgtgctggtgctcgttgcgctgggcttgcactttcgcgtgctgcccgtggcgcagcaggcggtgcgcgggcactggcccggggtgctggtgtatctggggatgggggcgggcacggcctacatggtcaggtactcgaacaagttctttattttgctggagctggcggacatgtggattacgctcgcgtggtttggcggtgctttcgtgctgcatgggatggaggttctacggagacgggtggaggatgatgataaggctcagactgaggtgaagaaggcggcgtcacatgtatcaaagactggatgattgcactggttctggaaacttgagtaaaaacaataaacttgttcattcttcattcctgaaatcgttcaagtaaaccaattaaagacagaaagaaaccccttagtcatttctgaccacgtccacattataccaaactctgatttcccgttcgtgtctatttaagctgctgccccgaccatctcaggtccaacaggcagttggcttcctgcaatattgcactgcctgaacagccggacctcgtcctctgcaaaggcaccgacgaccgagtggatcaaacctcggttgtggaagatgacgagatcgccttccttccagtcgtgggcgtatatcctctggggagcaatgccaggtcgctgcagacggtagacagtctcgcgaaccttggccaggtcatcaatgacggtgccatcggccagatgaagccgcctcacagccgacgggtggatctgaaggtgcagcttccccgtcacggggttgcgccagcacatggggaggacctggatggcctcggagttgatgggagggaggtcggactcggagagctccttgccctgcgagacgaggccgagcccggtggagcgggacttggccggcgacatccagatgtaaggatgggcggcgtattcgaccttggtggagcgggcaaactccttgtcctcgtcagagaggatgtcgtacatggtttcaccgttggcgaaagcagtagttccaagggggacggtcatctcatcgcccgtgccgtcgtcatatcgcagtgtctgcgtgcggccagaggggacgcggacggcaagcagcgtggtcgccacggggggcgcgagatcatagagggcggcatcaatgtgccagcggtagaacctggtgaagtcgaggtcctctgcgtctggaattgtagtgtcatggaatgtccggtggtgagggtgccggagctggatgttctccagaccctcgtaggaaggcacaaagccgtttccaatgacctggacctggggctgatgcggaaccgtcttcagatcagggtgcaggatagagcgttttgcatccagagtcttgccgtggccatagttggcagtggcttccgggtcaaatcgctgggtgaggctgtactgggccttgggagagacgtgcgactggtccctgatgacgagaacctgatgtctgaacagagcatcacgaaggacatcaaagtcggcatctgcagggcagaaagtggttagcctcagtgtgttctgggccacagtgaagatggctgttccttaccaggaggttaccgattttacgggtattctcccatttgagattgtgttcttcgcctccattcgcagcattccattggatgccccgagtgaggtattacatcaaattgcgctcaaagaatgaggcagcgactgcaaagcaatcattattccttaccagtaagattctcaacgtcaacaccagtgacggtggcaccaaagttgatagcagagccctgtggcgccgcaatgggctcgacctttgcttgcgaagttgccatggtttagatgtgatgaatgtaattgtttgggataataacaagttctgattatatgatggagattgatctggattcaagcggcaaatctgggcctgtccgtcgtggtgttggagaagggaatcttggatttgcaaggcatgaccaggctgcatttataccccaaatctaagatatgggcggggtccgattcccgaggagcaagatctcttatctctaccgcgcaagtccccgttagtcaacgtcgacagaggcactgataacggtggaactgcgcccgtttgattaaaaagcgctattcccatgataggcctgggtttatcagccggctgcggaagctgacgatggccacatgcctctggagcagtgcggccgcagccgcccgtaggcacagagtggttggcatgaagccgcctctcacagaccgaactcgcccaatgatacagttcccatggtctactttgatgatgtttttattcgagggtatctaatcatatcaattcgtgaggctcgacaagtacaaccggagagtaaggccctcccctctgccttcgagcactggcaaaccgggtatccattcgtatcgtcctcgcaccttaacttttcttaaccttttccgtccattccttggcgctcttgacgccctcgtgggctctgcgaaacaagctcctctcccactcctccagccctcgcaggaactcctccccttgaccacccaagctcccatcatcggcctttctcgcgtgcaggcccacctcgccggcccggaccacaaacgtcttcctgagcgtgttgccgagctcgcgttcgtcgaagaggtccagcatccgcacccccacgccgtacaggtgcacgttctgttccctgagcgtgaccgagcgtggatcggcgcgcagcgcggcgatgacctgctcggagagacaaggcggcatgttgagtatcagtggcgccttggagtctcccgtcgaggcgagggcgagcatctcggctagccagaggggcagggacagcgcggttcctggtttcaggcctgttgtcgagttgtcgaggtggcctaggtacgggacgtcgagttcgaacgtacacggtactttctacgggcgatggctgtcagtgtctggctggctagtattttgcactgaacaggcaatgcaaaaatgcctcaaggaattgggatgaaacaaacctcgccgtctgtgaggatggcatcgacatcgtagtaagacatgttgcacgccttggaccgactgtgcagcttggccgctcgtcaatcgatcactactagatgagcctgtccagcgcgttctggtaaagtgcccctccaagccaaacaagagcgcgttggaaattgataagcgataagcaccacagttcgccgtaattccgcacccctccaattactgggcggttgatgctaatgtgacgaaccaactccactgaacgctaccgttacaagagcgctggggcaatcgcgcagtgacgacacattgatctcagatccgaagctccttcccgtagattacctaagcccgagctcgccctcggctatccgctctagagctttgcgtgagttgacatcatctccgtccagtttgttgtaatttatctccgccctcgccgtctcgacatctccaggttgttggtaagtccattcttgtctgctcgtagtcgccatttcatgctcttcatcttcctcgatatcctgtctcccaattgactcttgggatcatcatttgtttcctgctagctgaacttcgagagctaacccaccgcccgctttttgctctagctgtcgacataaaccaccacaatgtctgccctcttcagaaccgctcccgccctgcgcgctggcctccgtgcctccgctgctaagcccattgctgccatggccagcaccacctttgtccgtggaaaggctactcttcccgaccttgcttgtaagctacatcccaccacgccgatctccctccgaggggagaatatggcatcgcacagccagctaacacccaatcggctgaacagacgactacggcgcccttgagccctacatcaacggcacaatcatggagctccaccactccaagcaccaccagacctacgtcaacggcctcaactcggccgtcgaggccatcgaggaggccaaggccaagaacgacctcgccaccgccgccgcccaggctcccctcctcaacttccacggcggcggccacatcaaccacaccctcttctgggagaacctcgcccccaacggcaagggcggcggcggcgagcccgagggcaagctcctcgtacgttgagttgaactctttcaccccccgctagatcgccctgttttctaacatccccccccctcccgcagaccgccatcaacgaggactttggctccttcgaggccctcaagaagcagaccaacgccgccctcgccggcatccagggctccggctgggcctggttggtcaaggacaagtcctcgggcaccctcggcgtcgtcacccgcctgaaccaggaccccgtcaccggcaaccttgagcccctcctcggcatcgacgcctgggagcacgcctactacctccagtaccagaaccgcaaggccgagtacttctccgccatctgggaggtcgtcaactggggcaccgtcgccaagcggttcgagaaatagatttcgtccatctttagtactttaatttgtcttgtctaggtagtccccgtgcgacgggaaaaggtataattatgtacatatttacctcggggctctcagactgatgagcaacatgtggagaaggacgatcggattttcacgtatggacgaagatgtagccagtagagattttctcaacaattaaaaaaaaaaagtctcaaaagtataattttttctatcttttaggagttgggaaatttaaccaaaaaccacgcagtccttcaaggaagcgacacttaaatcatcatctcattatcgtcgctcatcaagaaacccttgaagtacggaatctaaaaaatcaaattgcacagcgagagtcactgcgcgctcttccaagctttactcggcgggcttcttctgcgtgaaggagcgaggcaggcggttctcgccctcggtgtacggctggccggcctcctcgcgggccagatcgtttacccacctctcgttgccgtcaaagtggttcttgctagcgctgccagcccacttggcggccaggtagaaccagccaagggcgttgccgacggtgccgacctcatcgctgacgccggtgcgagcctcataagccatcttggcgtggagctcgctgtcggtgcagagggccttgaggtggccggcgacggccttccagtcgccggggtcgacgaggaagccgttgacgttctccttgacctggagggggatgccgccggcgcgggtggcgatgacggggacaccggcgtgaagggcctccgagaccttgacctcgaagccttcgcgggtggaaagctgaaggatgacgtgggcgttggcgatgatagtgttgaggagctggtcgttggggtcgaggcgcatgacactgacatcttcgaggagatgggggtacttggtctcgagctgcttcattgtctcgtcatagatgatggtgccatcaggatcatcaacagagccatttccgcacctaatatgtgcgttagtatgggggcttcatactacaatgccaagcaggagcagaacaggcagtttacttacacgcagagctggggtgggttctcaatgccctcctcctcgcagaggcggcggaactcagcatagccgtcaatgacggtgggaatacccttggcggggtcgaatcgggcgacctgggcaatgtactttcgagctggccattcaagctcagtcctacatttctggttagctcaaactttcttccggcgttggggaaggggttcctccaaaactcacatcctctgagagtggcactgcatgttgtagatgtggccatagtagccagtatcccaacggttcaggggcttgttcaggccgtcaagccaatcagtggtggcagggaagtaaacaaccttctcactgggcacatcatggggaacgaaggatgggatggggtggctgatgaacatatcggccaacttgatgttgttccagagatagagccagacgtcgcgctgaggagatccatcgatggcagtgaggtcgtttcggatctgaatgtgcgagcggtagagcacagggcgatcaggggtaagcttcttgatgagggggataagagcgggcatctgcggatcatcgatctatcgattaaaaagacaagtcgtcagtactcgtgtcatgcccaacctgttgcattcttcgaagagggactctcaccatgacaacgtcagcaccaccttcctcaggaggtcgcagtgggcctccctcagagagccagtagcggttggcattctcatcaatccagtcgacaattgtggccttctcctcctcggagatgcgctgttcggggtcggcaacgccttgaaggatgttgtggatgttcttggtgatacggaacacaccaggcctgggcttgggtactgtgcaaatgaagtgagaaaatgacaacctacaacgagaccgaagaccttatagatcaatggatgaacacttaccataccaggtgagatcaagaccgaggagtctggcgaaacggacaagagcgtggcgcatgagagccacaccacctccctgaggagtgctgctgaagaaggcaatcttgatcttacgggtacggagatccttagcatagtggtgcatggcatcccatgttggcttctggcaagtgctgcggaagttgtacagctccagaagcttagccttgaaagcaccatcagtttgaacaatgccgcggtaaccgacgtgcagcagaggaactgaagaagggccaaagtacctatcatgacggtcagcttttactttgggctctattcgactgcagggggaaaggtatagacttcaacacttacatgatgcacttgcgagccatagagtcggcctgctcgtctaccgacttctgttcccagaaatggccgctatcactatcggggttgagaacaagcgggacgacatcaagctcgagccagagacgcgagcagagagtcccactgactttctcgagctcggggctgatgccagcgccgatgaacttgacaaagttctcgtgctcgtaagcctcgacttgcttgatgatgcgctcagcgatcaggtcatggccgtgctcggtagcatcatcaagattgatatgctcaacggagaaatcaagcaggtaggtggcgtcatgaatagcaagtgcaatgacaaccgtgtgggcatcagccttgacggcagacatacccaggtagagagtctagggagccaagtttgttagcgaaatcaatatccgaatcgaaacaggtgacgagagcatacagtgagcccaggaccaaaaccgctgccggattcgtagacggtgctcatctttctcttgcggtgagaggactcgctggtcgagaacctcctcgctgcctcttgctttggtgtagccatgatgatcagcagaaaagagtaccagcctcaaatggaaaacaggtatacagcagagttgattattggagaagtacaaaaggaatacttcaaaacacaatgtacgacaatgctctataaaagaccaaggacgatggagagaagggttgaacagtgagactcgggcgaaggacgactctcttttatataccgagagtggaaacccctcttcgaaagtacggtggaagcctcactctggacagcccccggtctggacgagtcagtagatttttgatgaaacaatgggcatgtgaccacttcagccaaatgaatctttcagggtagcctggcggtgtggacgggatacgggtggacaaagagtcgggctggcgaaatgcttgaggatggtgcggcgtgattggggagcaacgggagaaaatagcatgatgtggtactcggctgtacgactacccaacctcacggaagtacagatgtacacagttactggcccatggggggaagggagggggccaagggggaggggtgggatggtacggcttgttggagctgagtctatcgaaaggttgccgcccagacctatcaatcaggagactgacgtcctgcactgcgtcatcacggggtgggggcatcaaaagatatgtgaatatgcaagtaactcaatgcgtcagtagtttacatgtgagtaccttgctgcaagggaaattaggagtgagtcggatgcattgggggtagacgaagtggctgaagatggggatgggggaaccctccattgatcattcgactgctgggcacgttctggacggcttcaggcggtgatgcgagatggagacagcccagagtcgcggatccctcccggtaatacgggctgagaagggtgtttgggggcgcatgggggggcttgcaccatctgcatgacttggaggacgctgattgagcagagagctgccagaatcaggagctttttcgagattcgaccagaacggccaggccatgtgaccggtgtccgaaatgacagcctccaatccgtctctggtgcgtctagagctgtcggttggtttttagagtttggggtccaatggcactccaatttacctcgtccatcacggccagctcggctctccattccatgggcccacgacgggcgctactggaagctcttggcaaagcttctcgggtgtgagagctgcagagtctctgagagctccagcaagagggtcttccgtccgttagccctgcgacgggctgggggagtgtgacgggggattgcttgctctggccggggtaagcggacctgcagattggtcggccggtcaaagtttatgttcctggttcgagtggcaccgtcccacgtacgatgatggcacgctgcgacatgggccagcaacccggtctacgcgcgcaggttttagagcctttccatgcatgaggccatgcacgacagatgcaggagccggagggagaagatggaaactgttgcatggcatccggctgaggttcaatcgggtgtttcttttctcatgcaggtagatttgcgaagggacccggccatggccatattcccctagaggcagctgttcatccagccttgcgcgtaaagtcggtgggtaaagtcggtcaggcgagccagatctgtcttgccgctggtgctgccatgcaatgtaatgtagatgagctggcatctagatagccagcttggctcaatatcaccctccctcctggatgtaacggggacgggagcgtgtcagactcggacgatgaatgtgcagcagtgacacaggcacagcattagacacagcccaaagaacctcgtcgagaattgtattcgtctggctttgtttgtattgagagaggcaggtcaatgtgcgatgtacgagccgctgcctctgtcgatacttgggtacagaccaaggtacttggcgaggggtaagagcacaggatggaaggcactggaggaggagcaccttcccaatggcatgtgcaattgtatcagacctcagggtcgtacctgactagtattttttagcagctcagggcgtgcctgccttcatcctcgcgttacgtacagcagtgaaaccgttaattacgggctcatcaagcgccgagctctcaccatctccaccacaattgacctcgcctgacttggagtttcaacgaaaagcatcaagcaagcgttggcatgccaaaaacgagggagatgtcggctctctccaagcacaccgctgttgaaaatgggctttcgaagaatcccgggatgacctgattcggtctccgaagcgctaatggtccgccccaacttgcgtccgcctcgtcagctcattcttacccacctcaccctgtggtgcagcggcaaagcccagcagcagtcaatcctctgctcctccttggctgacctgagctggctgaaaacgagcatgtcccgacgccgcaatctgtccaccacgactctgctttccgccaacccagctagcccaaccacccccagacagctcgctgtccaatccgctctggctgccgatccggggaggggagttcccgtttgccacgcctgcccgtcttcctgatgaggcccgcatccctgctggctggcctcagtgccgcggccgtctctgcttcgtggccagagcatccaggagccgccgacagccctggcttcgctaccagctacgcggcgcgcatccccatcaagcccagtaacgagagcgcaagggccaacgcgttccggatcttcaacgcaatccactctgccggccgccaatggggcaccgccatataccacaatggcttcagcttcatgccggccatcatgcccaagggcaccatcacgtatcacggcgccccagacaaggatcctccggctggcttcgagtggctcgcctatgagatagagcatgctgagaattttgctcgttccgagaagcatccgcatcgcccaccacctcccccttggaagggggaggaggctcggttccagaaaccgcttcagccactgggccccagccataccggtgctcaagaggattctacaagcagtacatctgagggccagtcacggaggggttatctccaaacgtaccaagccaatcgtgacttgcacttgctcctgattgatgggatgtctgctgcaaaaacctccatgggcacactagactcccaggatctccttctccgcgagaataagactttcagttccggaatatgggacgaatggcaacgggccgaggacatttgtagcatgattgctgactggggttatgacgggtttatccgtgatgaaattggctttgaagtggtgtattgcgacttttcccaggggttggatcttatttcctccacccgctccttttttcaagaggataagatgggcgactggagcttggttctctggcagtgggtaagagccgctggggaacgatacgacggcatctcaaatgatcgtgtccgcatcgatttttcgtccatggtgtcaggattcttcttccccatcaacatatccagcaccaatcccgaaagacctgatttggaaagactcggagcagcgtcccttgaggagctggtggacataaagcattacctggctcaagtggctaaacagcctcgtcgcttcaccgtagattggcagggtgctgtgattgacctgattgtgaatcgatatgctgctcgcatcgcccatatggccacagaagacatttccactgaccacttcatccaagaactggaggggatcgctctcggctacatcaatgcgccggaagacgatgactctgagactggaggtgcatacaacaaagccaacgagacgatggttgccgttcaccgctgcacccagcattacttgcaccggagctatgcatctcgcagtgaatggagtgcgtcagacgagctgattcacaccgcgattagcagcatcatggagggcatttgctcgactgtgttcatcatgcgttctatgctcctccaagcatcaggaatgacagagagtaccgcattctacatcaacagaaagtctgacaatgatgaaatgcgacgggccgtggagttgagtagagccaagacgcgcaatatggtagagaagctcgggtgggcagattggaagaggacccgcccatgcccaatcgacgaggtcctcttcgtcgccatgtggccattcggaaacagtgacgatcactggaacccaggctgccgcaccattgatgatctagcatccggaattcggatgggatattggttcatggatagacctcctccacctccttagctgatgaggcctgcccccttgtccttctcctgtcatatgtttcaaatcacatatacgcatatagttcaatctgtgaatatactatccttgactcttgcagctcctccgcaaatcccaggaatctcacatctcacatctcacaaaatagcaaacatcatggccgaagtatgcatcgagacgatcacacgccgtgctacgacaaatatttcaagattactgatccattattttccagaaacaacatcctattgctttccaccagaaaagaggctcctccaagactctcgcgagatttcaaaaagtcaagatgaagcggtgagcatgcataacgcacccggcccgtgtgtgtcagccggttcgaccctttgaacaacctaccagaacgtgaaccccctccctaatggactgtgtaaacgcaaaagggcccaaacaggtacgccacacggcgaaggaaaatgccaaatcatccttcgagaagggccgataccgctgggcgcagatcgctcgcacagaaaggtggggaggagatcgtgggcgctctgggagggtgtttggatcgcaagcacagagcatggggtgatactacgaagccttcctcgacgggtcagcagctggggataggcaaggcggattactctatggggggatgtgaggtgttcctctgcgctgccgtggcacgacctggagcgtggaaggagaggggggagggggaagcttgctgggtcgtacggcggcggtacttgggtagccgcttgatggttcatcatataaaccaatcagtttctaccgatgcatgtctcaagcgagatctgatctgccttcaagatcgtggaggtaatggcgggtgatctcgttcgtaaaaggaaatgagtgtgatgttacgggacacacgctcgatcatgtctgaggctgaacagagacggcaatcgacagggcagggacaagtaagctgccatgatcgagcgcctatgctgccttgtgactgatgacatattcttaattggacctattggccaccggaatcaagttgatcagtgggctgcagaaccagggaagaaggtcgatgatacagccctgcatgtactcgccaccctggaaagcaggatacggaagtccagcgtcattagcgactttcggatgcacgttgccgcacggctgtacccttcaatctgttccaggatactggatgtgaaggggggtgtatgtttgaggaccctccgccatctcagggattacgaatggcatgagccctaggaggagccctgtcccgcctcgtacgagtgccactctgaggtcaaataatatccaactatctcagccgagagaagcttggtagaaggagaaatagagatccaaggcgatacagcatatgtgcatgtgctaggctaatcccatggtgatggtaatgaggagccgacgacaagggagaggccgagggtgagctgtgaagatttttggtatgacactggcttggttcgagatctgatccccctgtgcttccagaattatggaaaccggggttttggagatcatagagcacagtgtacttctggcgttcagggccagggattcccatgggggcgaggacccggcagcatgggagcgtccaaaattaaactggccaaccaattctgtagaaagagggacttcaatacgcacatcatggatttttccaatttgtcttcccggccaagtttctccagccttctttcagatgcactcgcatatattccattagcttcaccaagtaaggcttggtattaagcgacatggctggatgtggcggttctcttggccctgaatcaaagacccagagcagtgagacatcaccaccttgcaagttgaagatccccgacaccgcaatttgagattgagttcggctgatcttgggacaagaccccacatgttcgagatcgaatctttatttctcaggaggatcccaaactgatgctaggatgcgaagtctcgtgatatcatggctgcagaaggggacgacgccactcaagatgctggcgtcgcagatcggtggtaccatagatcagcgactgtgcttccctgtcaattttcccgcccaaggtcaaatatacgagagcctataccgtactttggccccctcaacatcagagtagagacgctacaaaggcgggtcaatcgggtgcttgctttgctgctctgagaacagaccatctccatgagcttgacatgggcgcctattacgccatagccgcgagttcaaatcggaggtgtcagtaagagctctcgtcggaatgattgcgctgttgccctgctggtgaagcgaaatggtgacacgatcagaactcggtcagggttacgcaccaagcctcaactgtaaccatccgctcttggcttgccctgaaaatgtgcggtcagggaatcggtgggccaaagcgcatgcttatgaaatgatcgcaaaggtcgcacaagagtatccccggacagattatagtgcgacgtcccttacagcaggcaatgcgaaggttacaccatctacgccatccaccttggtgagtaacaaatttgaggggttcaaactgattctcgagggcaagatcgccagtcgtagcatgttcatgcatcgatagttcacgcgtgattatgtgcccgagaatcgtcggagaggagccatgacgagaacgaccggaagcatcccattttggagctctgtagcattcacaaatcttccacgaaagcctccgaaccccatggccggactgctgcaggcgtaaggcggcagcctaggaggaatcgatacgacatgtcacaaatccacttacccgggcccgaaccagtgggctgggacacgataccccaacataatgggaaggaatgtctcaatcgaaagcatcggcaacttcggaggcgttctactatcatgatgactcgcgggtcgcgcaaggttagtgtaggcgaatcaaaaccccatgcttgaagccgcagcactctgaagaaaccctgccacatgcaagtcaatctctggatcacttactcctctctcatgcacccttgtagctttggcgccgtcgtattctcttaccgcgcagtaaaagacgaaaaaaagggtgcacacgcacaacaagctgtgatcatggagagaacagggccaatcacgttatgccggcgtaccgtccacaacatggacgccatgagggccatgcgcaagccaaggtcaggtcaaggccactgtgcctttgcagaaactacccctcctcccctcctttcgccaatctagagagccgcgtgcgccttgtgggatgtgcctctgggccacccacctctctccccacacacacaggcacaagtacatggtttgcggatgtctgtcctggcgtttgatgattcgaaacttttgtctcggccaacaggagagacgaaatgactgagcatgtctaaccggaggcagcttctaggaaaaggcgggttcttgttgtctctcaccgttcggcggcgtcctcttaaagcttcgtcgagtcttccacaccccattgcttgttgaagagatggccatgaccatggccgataactcaatccgaaaagcttgcgatcgctgtcattcacagaagctgagctgtaaacgcatcggtgaagagccctgtgaacgttgtacgcggctgaaaaccgagtgcaatttcagcccttcgcttcgccataaaaagcagagcagacagcagaagcaacaacagcagcaacagcagcaacagcagcagcaacagcaacagcaacaaaagcatatccaacaacaccaaccgcaaccacaggatcatcaacatcaacatcaacatcaacaacaggcccagcggttatacgggcaccaacagcctcctcctcctcctcctcctccaccgccgcaccaccaaatccatcaccaacacttccaacaagtgccccatcaggacgcccttggtgccgagataactccagtagttggcagtcggtctccgaagaggcgaaggaccagcagcgacccaatccttgtattacctgagacccgtaagtgctcttactatgcccattccatgtcttgatcaatagaccactgactcatatggttgccgaacgtagtgccagcagtctcgcggacagaagcgctcacaggaaaaccccatagcctcgtgacatctgagacagggctagacataagcgagtttaacttcaactttgaccagctgggcttcttcgtaccgcctcactcggagcacttatctcaccccgcgatcctttccgataaccttcacgctcagccagtccaacaaacaggaggcttcataaattcgtgggaacatcaccacctccccacaacttcagaggcatttcctgtgatagaccatactcagccccagccccagcctcaagctcagcatcctctctctcaaccacagactgagcttcatcactctccacagatcccctcctcctcctcctctcctgtcgccttcagggggagagcttgccagcccaaaccgtcttctagcaacagtatcaacagtaacaagcgcccacggttccggtacggacaaagccctggacatatttcctttcttgacacaaccagcctcagacagctgcaagaatcgaattccagccccacaacaacctgggaagcctcaccggtcgtctggatggcggaactaaacgagatcaacgtccgcctcctggaactgtcgactgccctctcagaggcgcaggaggcgacccagcctctcggcaggccctctaatgagaggttcagagacaacgggtggcccatcgacgagatgttcaacctcacgcagcgcgtggccgaaatccttgaccagctcgcaggcacggccacggagcggcgggccagcgcggatccaggcaactccatgtttgtgctatcgacgtatgtgcggctcctcgacatgtaccagaaggtgttcggcctggtgcagacggaactggcgcagaccgacccggacgagatgctgattattgcctcggagggggtgtttcagttctggaagctgccaaacgtgaacatcggctcgatcccggtgaattcgacgccttcgctcgccatgttcctgacggcccagctggccgacaatttcctcggccggctgcgcaaggcgacggcggctctggacgcgtcgctgaggaaccccaagaacgcgacggtcaatgggcaggccggctcggggacctcggcgacgtcattgtttgtagatgtgtcgtacgacatggtaaagaacagggaggagactctgaccaaacacctggcggagcttcgcaaggagcttgcgtcgataatacctatgctggattgtgatcaggaagagtagtaacgccgaaggcagtcagaagctggagatggatcttctgtgtgtgcttggaaaggcggtcacacgtggctggctgaagaagaagatgttaatagcttggatcttgtgtgagacattcttttggcagacaaaggctggattgggtattgacgatggcaattacatgagatgggctccttcctcaaggaagcggatgtgcgaggtggtactaataattgaagaacagactgggactcgcagtgcaattacactcctaccagtttgtttttatagacaatctgcattcatagactccgaaatataacgttttatcgtttcttggatgccagcgatggcttttctcgatcaacagcggttgattcaatgacatggccatggcgtcggctgtatagggtagggaaggatcgaagtgaccacagaggagcttccgttagtggagcatcgcagggcctttgacacttgcaatgtccgtcatttggagggcggccacagcttccccaatccatcgcgcctatcgtgatcacccttgttgtcatgtcaataccgtcgaggaaggatcgtcgccagtatgcctggggcatttgaacgtatgttcttcttgtgatactagagggatcttgtacgaacccgtgctgggagagaccgggattctagtccaggttagccagaggggaagatcaatttcaacaccatcctctacgagcgccgaacgagcagcattcaacccggattcatttatctaaagcaacaggtaacaatagcagtcttaaataaccgggaagctctggaacggccctctcttggcgcaggaaatcgtgggccccaacaccatgatccgtaatagccagatctcatccccggcggcttacagtctatttttaaccacaacccgtctcgaaaaggaattcatcccatgacggcaggaaaacatgcagcttataagaacaatcggggagaaccacgagggatgatgtagtaattgtcaaacgaaccttagcctcatcttcgattgagaccaattttttcccccctccccggtgggaagcaatcagcagtctcaccaccacaggcagcgcctcttctcttctctttcatgtccttgtaaacatcttccggcaagatgcatttccttagtattctttcggcaggtatcgccctggccacgctcggatcggccaaggacaccagatacctattcacattgtaagtcaaccattgcgacagcggagagcaaggcatctggcctaacacactaccagcggagactcgtactcgaggacgggcttcgacatcaagggcgacaagcccacgaccaagaaccctctgggcaaccccgccatgcctggcaagacctcttccggaggcaagaactggatcggctacgtccttgaggagaagaacaaggatcatgacaccctctcgtggaacttcgcctcgggcggcgcaaccgtcgacaagagcatcatcgtcggcagcaagtccaacgtccagagcttcaccgagcaggtcaagagcttccaggacaccgtgggcaagaagcccgactatgccaagtgggacggcgacagcgcggccgtgggagtctggatgggcctcaacgacctagggacatcgtactatcgcaagaactcgaccaaggtcatcgagaagtctgtggacaaatactttgaggagctcgagagtctctacaagaccggcattcgcaagttcttcctgcttcaggttcctcgtaagtatcagcattaagggtgtgccctcctcctagaaagctcgaagagactgacctggagaccaatagctacctaccgcactcccctcatccagaagaagggcaggtccaaggccaggaagctccaaaaggctaccaaggcctacaacaagcgcctcaacgacaagctaaacaagttcaagaagagccacaaggacgtcaaggccgccctcgtcaagacggaggcgtccttcaagaaggccctggacacccccaagagtgtaggcgccaagaacaacaagtgcacaaacaaggatggcaagtcatgtgtaagtaggcactcccatcccatctctgccttgtaggccttagctgatgatggcttcctgttgcagttgtggcgcgacacctaccaccccggcactggcatccacaagctcgtcgccgccaaagtcaccaaggcgctcaaggacatcaagttctggtaagaggcggcgcccaaaacgcctcctggaagcgttcagatcagccgcccatctccagctggacgatcagcgtgtactaggcctacaatcagaagctcccagcacgccacatggctactggtggcttgcgtgccagcccgcaatcagtcagaaaccctccggcgatcatggctcacgagcttaagcagccggctctcggtctgtcgtgctcgaggtcatgccccgggctctttcatattattttcatccgtacatattttgaaacattttgttactggtttatcttcgttattatttattacatgtacacataggattgtacacatgaactaaggaactacatccaagaaggcgttgggatttgaatgaataggaaaccttacatctacatctacattgaataccttactcttaccatgtgcattgccataccagcttccaccctctcccacacctcttatcatttgaccgccaattgtgactgcacatgcagatcatttattccaagccccattctcctacttgactctggatccgcgcagatctcggcacgtcgagacggtaggtatgcgcgcacacacacacacacatgtagcacccaccatctcgatagctggcctactgaaccccatcacgcatgaatacgaattcgaaagctcctctagcccacgggcgagtcagtgcgaggccaccatgtatgcgcgcattaggcttaaagattcgaaccctcagccctccagccatattttctttttttcctctcccaccgcgtctcagccgccagaaaagcgagaccgaaaaggggggacccagcagcctgggactgtatgcacagcccggacaattcgtggtatagctcaggcccggtggcgtggatttgggtcttggtcttgtttattacggtccttgtccttgatagcgtcgccttacccgaacaggagattttacgaggaaagatgtactctaccttgttttctatcggggaggtaggtaccccggataggcctcccgccattagccgtcacctcaccaccgagggatccgtctccttgggacagaccagagaagaagggggggggaaggtcattctttccgtgttattcgtgagagaaatgctttaggcgagctacacgcccccctcttcttcctgagttagctcctctggcttgggccaggcccctagtaaatcgttcatgctggtttagccctcctcccgtgatgatgcacgttacatacacgcgcggcagtagttcgatcgcgctgattcatgtggtctcatctccggattccgaatcagccaagcagacggcacacaggacacacgctgggtggcactaagtgatggtgtccaatgccaggcatgtcacggcaagggtcgtctagcccgccatgatatgcagctaagcgatgggctggtgtgtgccttttgcttttcttttcttgaacaccagaactggcgcaatgcccgagccggcaccagccagaagaagcataaagccgccaaaatgtcaggattcttgtggtaagacaaagactcatggcaattaccgcgtccatattcgtgagaagctgaggtgtgagcaaaccaccaaccccacataatacttctatctatacctgtttgcctacatttcgactatctaaattagatgtgccaccaatagtctgcgatacgcattactgctcctgtacctattattcgatgagtaccgaacaaaggtatcctggtatcctgtaattctcctcgtagcaatgatgctctgggaagcgtcatcttcatgcagtttgtgtatttgatccacctttaaagtctcacatgcccatatgtatatcttcaataagcgcaaccatctaccatacaagtctctccccaacttacctaaacaacaccttaaaatttagccgcggtgtttcaatagacttggagaagggatcccacgtgcgaagagggggcgtggagtaatcttcggtcgcgcacactaaatgatatgagggctcgtcttccttgcttccgcaatctcgaggtttcacaatcactaaagaaaaccccccctccatttccttgagatcgttttccaaaacctgccctacatggatcccgacccatacccgttagtacagactcggcgtagcatgcggtagccaggagggaaaagaagccacgagggaacaagtggagcggcgcctatttgatgctatcaatcttctcatcttaacgccggcgtccgactgccctctatgcgccggtggcttgccttcttgctggcacaggcgctcggtttgcccaaataggtttcgttgatggcgtcggttttcgcaaactcctcctcatcaagcagcccgccccccgccagatctgcgtgccctgaagtcacgcctcgtggctggaagggaggaggggggggaggcgtgtgaggatctagttcctgctggtaattaatagcatatggcgatgtatcttcccgtatcccgcatcctggcgatgtttcatcacaagtagccatgaccaccgcggtcgtactgccgaaaaggtgttctcagaaaaagaaagcatgagcatggtgaggtcaaatcaagcccagcacgcaggatgcttgcttttttttgctccttcctattcaatgcttagaccaggctcgctggcaagtctgcggcatacgacgcagatctccttggctgcatgtggccaagctcgaaatctctcaggccctcggatagggacgagaatagcaagatggatcgacggtacgggatgttcgtcaactcggttaagctgaccccagggatgacgcctggacgatatatcgtcgccacgttgcggccgagcgcaacatccaggtcgtgcgtcacagctcaactgagctggagttgatggtgcggcgtcaaatctgcaatatgctccctgccgggtcttttcacaagcggtatagcatacgcgcgccgcctctgcttgcgcggtatattcctgatgcgcggcatattcctgatggagggacttttggaagccgctgcagagtgtgcataatttgctcttcggagtttgtcatcattagatatcgtatgtgtctcgacatcaggatgtgcctccgtcgtgctcatgaaattgagaccgggacggaacgtcccgcagcgcggcaacgggatgaacgaggcgtggagatagacattacggacgctggaatgtctcacagtgaaaatcgcggcttgcaaggtcagaccattggccggcagtcttgtctcattccaagttcagccgtgaaaagcgtcgtataggtctgtggccgctgtgatgagggagggtcattagctcggaggcagacatgcttgtctcaatcaccgcgtgttctcttccacttgcaccctctcaggcagctggagaatgcaggtgcaggcattttggcgcaatctagtgcatgacgaacaccgcactatcccgtaacaagaccagccacggggtgcctcgagtacagtaagagcaaataggaaaatgaagttcctaaaaccaagcaagcaaaagcaaagaaagaaaaaacggcgggggctcggtgctccagctccccgcctccggcagtccatcacattccgtcctggttccgcccacatccggtaggtagcttgattctgtgccccggcggttaccatcattccgctgatttctgtcggccgctcccgctctaagttggggtgacgggattggcctccttactagacacagcaagagccgaagcgtgaaacctgttctggtgttgaattgtcgtgtgccagcacggcagacatgtcccgcagccataaagcggtgacgttggggtgcgattcgagtagaggacttcagggtaggcacacgcggaagtgttcagctggtcccgaacgcccccccaaatccctcccaagtccgtgaggggaatagtgctggaatgagaggagatagtcaggtggccattgttacttcgagagccaaggccggctagtcttccatgtgaggccctggttcctggcttaaccaggccgccgggccaccagtggcgaatgtacaaaccgggctctcacgtcaaaggcatctccggcggaggcagaacaacccatatccatacgcccatcagggacaacccagtataggtacggaagcgaggcgggctcctgagcactgggcatcgacgatgcccgtggcaacagcaagcatctccagccactacaggggtgatgaggccgacctggaacaagaagtctcagaattcaatctcgggccagatgaacaaaacagtaaaagcaagaggctcaaggctgagcggtacgtgaggtagggcgcagtcttgagttctggcttctctgtgtaccgcaccagcggtggggaaaaggcttcgtttctcttggctccatccccagtaacggcctcacgcctccccttctgccgtccgtctcagggagcgtcttagctgcagcatgattggatccggttgcttggtacgagacatcatcagcgggcagcccacccttgcatgccctgtcgatccatgaatcaagcgcaaccctcgccaatccattggcgatcccatggcgacggcattgggattgattggtactgagccatgtaacctaccgtacccggcttcagcgcccacggtcgttgacactaggcgtaaatgggaatcaagtgttgttttgctgctgccttgggaatggatcacgtcaagtatggatacgagagaggatgtaacatggccgagacggagtctggcaacagcccgcgatgacatcttgggcccgtctgagcaatttcgctctaattgatcgcttgctggcgtctgtcccgtgacagccccgtgatgccaatcaatcacctggcacagctccggacggtggtacaggtgggctcttgtgcaaagagaccatggccgctcccccggggctcaagtccctctcttcttcctttgcttccacttcactctccgtctttccgcctgaccgggctccttgtttaagcttgtgctgggattggaataataatgtagaaggtgttggactggcgacgggccgcgcgccgccgagaggcaaccagggcagctgtcagggcgttaacctcgggtgagcgactgcgaccgatggaagaatttccctctgtagaaggttcagactttcgcctgcgcatgttaacagaaagaataccctgtctcggcccctctccgagacaggacaggcctcagtaccggctgctgtcccccaggtccatgccccatgtctctggcagcccctctttgatacttgacacagcctgggcgtgacctgggtcgggccatcttccccttcgtcgcccagggctcggaggagaggggaggggaggaaggcagtcaagcatttactgttgcacaagacagggcccttgttctgcacgcacggaatgtcacgtatgtatgtatgggtggacgtatgtatgtgcgtatcattgtatgtatgcatgcacacgtgcatgagcaaggtgggcatccatggggatcttccttgaacatcgagcatttcacttgaccattgaggcgttcgagcgcgcaccgcccttgggtcatcccttctccttaagcgcgcgcgctggaacatctgcattgacacatacagcagttgagcggtatacgagcagcccccaaatctatctgtcatcggtcggtcccgcccttctcgccatttaggcgagtatagggcaggtccattactcgtgcttgcgttatatggatatgtagatggcgatatgcgatcgtgatacaaccgtgcacagtacatagcgccctgaatacattctgctacgtaagcccatttccggtgcagatcgcagacggtttgattgtccatgcgtgatatcgacaatcccggaaacatatagctctccaaggcaggcatgtgcgtacatgcatgcatacgtacgtatgtgagagacgcaagcgagatgcgggggcgcacatcgatgactacacccattacatttgtgttacatatggaaacagggtcaaatctggccggtttgaatgatggcagcggcatccaggcagctcttatcacgggggtaagttctttgataggagatggccgcttcgatgatacggaagatatggctgatatgaggatagaaggagatttgttttcgtaatgggataaacgaaagatccagcaccacgtagccttgtgaggcagcccaaaacattatcagttgtggggagggtggatggatagagcatagtccagaaggctgacagaagcagaccagaaggaccagccctggtcaaacaacagccaaggcgcaccgaaacaggcatctcccaagctgaagatggcgattgtgtcggtgtcaagccaattattggtgctccagtgaccgtctgtctcgtatctctcccaacccctcgccatcccccgtcctgtcacccaatcccaagtcccgggacccttgcacttgcattctgaccggtttctgcatttggaatgcgggagcgcgggagaggaagcatgttggtcgctggccgttgcctgggactctgctgacagcggcacttagcggccaaagagacacattcgcacgtggttcgccaaaaataccctgagggatgatgactgagagggaaatccgtattatgaattgctgatattattgccgttggccagataggcagctggggcgccagatggtgagcacatactaacgtaggtctcgagatatagatcgatgcgataggcgggagcctgcccattatgcgtccacgtatgtaatagcaaataaggccatcgcaggctcgaatataacggaggctgcgatatgggtcagaaacaacgtttccaatcatcaagggctgactgccatgtgctcgacgacgcgaaatgaaaatttcaccagcgaggcggtcaacgtctgtctgctccgctctgtgttccgtgtcgaatcagtacggatgaagcatatgaagcttatgcaaaagaggccccttaggtgcgtgcgtgcatacgaactcaccactagaccgtctcgttttagactgagacggccggcaatttaacccacgtgtgtgtggatcggaccaagcgtcccaaagataggctcatttagtgcagacacaccttccaccgcatcgtcgagaaagtaaaacccaagaggcggtcgcttatctccattgcttggaagaagcggaatatgtgcgacggctaggtggatgacctgtgctgcgagttgggatggcactctgacctggttgctgatatggctggacacgcgatcaacatggaggtcagataattatcggcagcgagcgctttaatttgtcgatgagtcaggtcctcttttttcgtctccctctctctcatcattctctcacacaccagcaggctctcgctggcatgtacatgcgcccggccagtatttctttcgctctcgcatcttcatctccccgccagtccagtctctctgcctcacgaggccgaataagcgtggtttttctgtaatcgggtgcaaccgaatggcgtcagtcttgtgcgtcacaggggtttatgaccacccatccactcacccatgtcctgttgtctgggcacgtactgtatcatagcacctaccttcatgcgacattctcatgttatatctctgtaatgcttatgttctgcagggtcagcgtccacagaccatcagccaggtgacagcttggaccgtcctattaaaaacacaaacgccgagcactgcatgaagcacactgcattaaccactgagacgagcgcactggacctctgtgtctgcaccgcaatccttggtgttgtgacttgaagcatggaatccacacgtactaaatgaactcaaccgcctggtggaggtggtcttggtggtggtggtgtggagatgagcgattcttcatcctgtctcgttggtgcgaaacggcccgtgttaggaagctgagtgttgcttggatgggcatcacgcgcaggtccatctgaggctccgagggccgaaaaagcatatgactacaaaccaagtaggatatcttgtccgggtcggtggccctggctggcctgttacggtgagttttgcatctgggtggctttgtgcgtgcccttcacgttctgatggctgcccacgccttccttagttcctggccaacctcaactatcatggcacggcacgtgtcccgtagcggccgggacccattagcactgactcgccctggtactgtccgtcaccgcagtttgtcttatgtgggcgtcttggaccgttgagaagttcctggtgaggagcactaccggggcacaaatggaacaaaaattctttgcccgtttggactaagcccggccttatttctcctttttcggggctgggaggggtcgctaggattctccaattgaggcggtttggcattgccggacagggccctatgaggaccgaatttccttgtttgggcatgctgcgtcagtgtgtttacatctgtggaagctggataccatctccattgcatcgccgtggtttgactatgtgtaagagattcgcatgcctgcgactagccacgcaaggtggatgcagcacgtgaattatgtaggacattcattcaccaccccttcttagccgaccgattccttgagggatgtgacattctgtcaaacaggggttaaggtaagggttttagctaggcaagcctggaggagattgaaaggagccaaaatcaagcatcggcgctggaggaatgagtatctctgcagacgacttgctccacgtggtatcgaggaccagcaggtcggttcatggaagcttcggacaaggcttccatgactggcctgcccgcctgaaccctgggggtcgcgaccgctaatgagcatcatttggcaaggctcaaaccaatgcctggccagacgcagcaggtgaggcggggggatctgtggcgtagcgtcttgtctaacgtagtttgatgaggacctcatttccaagttcaaatctttttggcttccactggctgggcgctggactggataaaaataaattttcggtccccgtcattagaagggtaccatgctgggcggcctcggaaatttcctgtggccagcgaccatccgagccaggggtcaactctcactctctagtgcaaaatgaaaatttggcgtgctcgtccgtctctgcattagcagtaccgaagctgttctcatggacatagtctaacggtccagcagcagccaccgagctcggaggctccattgtctggctgacgaacgacgctgcccaacgagcccacctcttgttcaggcctaataaagggtcggggaatcaggcgcagtgctggtgcgggcggtgcctggcgactagtgtgtaacactaagacttggaaaatgattcagaaccatttgcctgaccatccatccgtctcgtcctaggcacgtaaaggaacgtaggctgggcgggatcagttattttcgtcggttgagccgaccgacttgcagtggcactgcctggaattttcgcgcgcactgtcgtcggtgtgagaatcgagacaagcatcgccctgccaggccggggtacaaacacctcgtggcaagaccccgcccatggcaagtcgttatggcggtagggaccggtaggcgcacattctacataggcaggtatgtagaatgggacatgtatcgactattgcaagggaagttccgtcattgattgctaagaaagactacgtatctgcgcctgatagaggaggctgttcttgcggagagttggagcctccaagccgagagggtgggctggtccgagtagtgcgccgatggaaaaatcggtagggacccatgggtgcagaacagagaaggcggcgccagcgtgtacaaactatagtagaggcatgtgtgggatggatggatggatggatggattgcaggatgggatggatggagaagtaagtgagttgcaaagggcatggaggtttgtcactgcgggaggtagtggatggctgcgtgcattggcaggtgcagctgggctctgcacctgcggacacgatacaacacagcgcacgtaagaccgtacctggaccatggaaccaacttgaacctatgcagttaatagtgctaccctggcacttaaactcagcacaacgcacagccagaggcactggacctctctcgcagcatactgggccactcagcacagcacagcacagcgcaccgcaccagaccgcagcgcacgcaccgcaacactgggccgtcagtgcgcccaaccatcaaggttcaagtcaagcccgtcattccccataacacacaaccccagccctgtccagaggccctcacacgccctcacaggctagttggctccctacacgcccaccacccccctccccttcactggcgacgttcagaccaaaccgcgcgaaacacccccagcacacccggcaaagaccctccacccccctcccagagccatttcccaggtgtattgtactgtaccgagtgtatttcgctgccccccttcggtcccccctgggccctgctggcccgctggggattctctgggtccgactatggttgactcgttccagggtcatagatgtacagtacgtatattccagccagagaaagtctggtctcggcatgaaacctttgtcatggtatgctgggtgctggggtcccgctgctagactggaccgttctctgccgtcgtagccaaattcttaaatatagaggcacctcccaccaacccacacacagccgtctagatgaacaagcaaaaaccgacctcaagctctaacctctgttctggtcaagccgacgaactgtttacatccatccgctcacccatacatcaacgaccttatctctccctccccattgcttgtctcgtcccggaccaaagcccttgggctcacctacaacgacaatctccatatattacactccccgacatcagcaaaacaacatcatccagcatgtgcaactacatttatgtgggtctcaatgtttttttcacccaaaggcacaatgactaacatggcaatgcctctgtagaaggagctgagctgccagcatcactaccacctggtagagtcatggtgccccaagtatatcgagactcagcaacgatgcacacccaagattgtgagcaagcagtactggtaagttgcctggcaaccggatatatcatatcaacacgagcaaagtctaacatttctttctaggggtgatgatatttgtggtatgcacttccgatcctcggagctctccagagcaccgggaggcgtgtgaacgacagactgactgacatgatttctagctgcatgccgagaacgacaacagccttcccagcacccctgggccaagatgatcaagcgtcccgcctcacctcgagtaccttcgttctcccaggatgtttacgcccgatgaacgaacgcctcttccaatctctcgaacggaccgtcccatattcacagccccccccacctgtaaccttaacaacaaacaacaatcggttgcaacacaaccagatcgaaccagagtcggcgcctgaaactgcctaccgacacaattgtttctttcatatctgattatttttctgtttccattttcagtcttctcagcttggcaacattacggagttaaatagcatcagcgacaatgacaagctcagcgagcttcgtcataatattggatttccaacacacctccaccggtgtaaacagcatacaaaaggcgaaccagggaaaatcaacaaacagctccagccagaccggcataagtgggctcctttcaaacaaaacacttgtacattttctttgctttttttttcgccttgctctgatgagcaagacgaggaaagcaataatttccgggcatcactacgggctttttgcctttttttgctctttatttctttttatcagcttctatttggatggtcatgggccggtgtttagtctggtctacaggaaagcttttgcatggaataggatgggcttatttttttgattttcaagtattgattttttttgggaggaaatagcacaacacggcatgggacggaaaggaagcactgggctggacttcaacttcccgcattattatttttttgaagtagaaaaggcaaactcgattattactgcaggacacgggggggcgcgaggcaacggagccatacgacaaacttagaattaccacttcttcagagacaaatcaaaagtcaccaaattcctcacatgagctttttacccgaccgtttatctcttgattggcctttctatgactgcagaaaatattccccgacaatcacaccccacccgcagctatctcacccacggctggggcgtctcacatcataccactgccgtttatctgggcagagcaagagagggcatatttctttcccgatgggctattagtcactgccgcccccccgcgcgtgtgctgccagcagtatttggctttttcccttgtcactgttttcccttatcgcgccaaagatttctccactctccccctggcgggaagagtgcatgcttgcttgctctctcttgtttccaaaatatacgtgtgcgggtggtggtatggtgtgcgcgaccgggcgtggtcgcgcccatgacgctggcaaatcatcgtcgaatcacacccccacgttgctcatccggggcatatctgccctcaggaagcaagcatgtacgtacgaagataacagatgatcgagcaacaatcccgcccatcccccactctccctccctggtaaaaagataatctctgacatactgactgcccgactgagcaagaatctcatgaatttgggaaccagcttatgttgccggagagcctgggttgcagagagagacggacagacagcagtgacgcccatgtccgttcaccgcccgggggctggggcccaacatatgctacacattgcacaccatcactgcgcgttgcggttgggggccatgggcgtccgaggagcccgtttcgtcttgtggcttttgcctgaacgggtaactcaccatctcaagggcgcatgcattcgtccattcgtaatgcggaaatgggccgggccagccagaatcccatgcgcaaggggggacgacgacgatgggagggtgtgggtgcggaaaaagcatgcacgagtgccctatgccaccatccatcgcctatagtctgccgtgcttgtcggaatcgcccagacgactgtccgctcctgtagcggagcggcaccgcggaaagggttgggaggaggagatgaggcctttgggtttgtgcatgagcgagtgacatgccttcctggcagctgggtttcactttcgtcggccatgcacacgccctcgtcaattcattccctccattcactcattcactcgctcattcatcttatcacagcagctagccatcatcaaaccttaaaaattcgaaaagccttggtcacacggccaagtgtagcattgcgcgcgctacgggtaatgagggaaacaaaagcaaagagaagagtcaagctacagtacctactaaactaacggaacggctcgtagcacctgcggctactggcttacagtcagaacttaccagccaagcccaaggtaccgcggcctcgtattggtgttcatatctccctcgtgagcgtgagggatctcgcgagaaggtagagattagatgatgtcccccccccctgcgactcattcctggccggcctagccgcgaataggttcttgtgtcatcccaaacgtatgaaaagcccatggcctgggacgtggtttagtgcgcgttaactgacgctactgcacctccccgctggtgcactaccctgctgcctttgccttagtcctccacacagctcactccatgtgtgcttgcgtgttgagtagggagaggtcgtttgtgagagagacggcgaggacgcagtagctgagaagctgacggccgccaagggtgttggtggtggggattccggagctattgagatcaggctccagagttggagatgggctctggagtctctcctctctgcataccgacgtgtttggcgatcatggcaggtggggcgagggccctgtctgtcatattaacgcaaagagggccagatcggaggcggccaagcggttgtatgctatgtatgtacgtatgatcgacgcgcgcttgttgggtgcgtgcttccatgctcaagctcaaacgagcgagctccctctatcgtggggcctgaacccgccacatcggggtgcaatgcaaatcagcttagcctgcaacaagccatccattgtccgtctgaaattctgctggtccagttcgagctattgcatcacatcatcatgctagcggtcaaccactaacctggtttcgtcgaagcctcacgggaaaggggttgcagttgggtagctgccagtagctctgcaagtgctttagctttggtcttgggggagccgggattggtgtcaggtgctctccatgtgctatttctcgctgtccaggcccgtgcttgggagcctaatcctctgggcgggaagaggaaacaacgcctatggcccagtgaccatccgcacctacaggaggtccctacagcgctgtatagcacaacgcagcactgcggtgcacaactgtccggcaaggcagagcacaacacgacacaacacaacacaacacaggacaacacatcacagcgctggtcaccaggacgatgcacggcacccaaagcacgacaccccgccgcacggcatggcagcgtcttacgccataccggctgccctgaatggttgagtttgggtagtctgccgttagtcagccggccagaccaaatcgagtgggcgagtgcgagcggcacactcagatggcggcctgattcttacctttggacatcatgatcaacgccctctctccatatttgtctcctgagtcagtgagcaagtgatgaactgccgcaaacccctcgcggtcgaggctggtcttcgacgatcagctcccatagtggaataacgtctcggcagtaggtttaccagggcttgagcctcgagcggtcaggtcccagcaagcaggatggagtccttgcccccctccccaggccgtttctctcgccagctagctcagcagagctcctggccattgggaaatgcgtcttcagctcgaaaacaaggcaaatggcacggaacccgagcgagtggtacgaggggaggaaaaaaaaagacactctggcgggttattccgaccaaaagtgaaatctgcacatcctctttgtcacccaattgggcgtcgaacgaatatgatttatgccgagttctgagtttacggttggccccgaggcgaacatgatagctccgttttctcccttctcttgcccccctccgaaggtgtttgtccatcaaccatgggaccggtccggtgcaccaacagctaacggcatcaatcatatttgcattttgactttccatgtagcaacggggccatgaagctccgcatcatatgatttgaagcagatgcgcaagccatgtaaccagatccactttgccaatgtgatatgcgaggcgcaaggaccgtcgtttggtgtaccagatgcctggaacgaccttgccagtgtattgtgggaatgcgtcccacttctgccatcatgacccggcggagggacaggggaggaaatttttctttcaagaaagtttcttcgggacccttggacggcgagatgcgaggctggctagcagcagagtgacatgcctgccttatcaaattgcgtggtcccagaatcaggccggcggctcaattcagagttgagatacgagacaatatgatgtatcaagcttcacggagagtccaattggctctctgggcgcgcgttacgaccctgcttggctagttggtctccccaaccaacaaaagaatccctaccgttcattaattttgagtttgaatacgccttgcctactatttgtcaagggcccaagaccccgaatttccgaaagtggtgaaaggaattggttcaccattcttcgttctcgcttgctgttattgtccatcattgccaggggtcgattccatgtatagtaacgttctctctggagctcaaatgtccaggggtttgtttaggtaccgaggatcccgccgtccaccgatattgcaaggagtgtggcagctgagtggttaccggtcccggtgacagccgactcggctagcactgcgcgttgaggagaaaagtttcggcttctgtcttggggaaaatgacaaggttattgcggtgggctggaacaggaaaatgaaacttggaagtttccagattcttgcaagtcagaattggaaagagaagttatctattatttcatgacaccacccacacacataatatgcaaacttacgcaatacaccgagctcccgatctcggtgaggcgtagaaaaggaacaattagccaacaaaatcacggcccaaaccgatcatcggaggaatcttgccaagccggcgcatgtggttgcctggcgtgtttttggcgggtaaaacaatccgtccagggctcgcatcctacccaattccgttctctagggaatcccaggggagtggcttgtcaggcaatcttttctgggaaatcctcgaggaatattgcttctctcacccggcggcgaggttcggctagtgatcgagaagctttcccagttccgcgtcagcagttgccagggatgacatgcattacccatcaggtcttcctttgggtgctgaaccctggctttggctccctgtgaccctgaccttttccttgatggcctttggtggaccttttgtcctgccttctggcacctgtcaaaggctaccagcccccctgctcccccctcttgcatcccttaccccagacagcccgagagtctgttttgcctgaggagaaacgtcgaactaacccgcaaatcgatggatatacgtacatccatcgagatgtccaatgcataaaacctccactcgcatagacacctgcatcatccttatccaccgttggaaaatgcaacgttgatcattgtttgagaaacgagacaatcaggcttggccaagacggatcccgccatttgaccatttgtgaaggagcgtccagctggtctcctcgcgctcgctgtccagtcatcgcctaccgatctgggtgaattgagcctctttcccatgatcgctcactcttctaagcctgcatgcaaggatacgtgcgcccgcgcgtgtggcgccaagaggtcggtcactgtacataggtctggccttgagccgcctcatcatctctctcccatgccctgtctcgccctgctccccgggtcgccaccagcctctgatgcgggctcgcctgtaccaccgcacgtggaggcaacaacttcccggaccttccctcttttcacgggcaaaatttcacgcacacggagaattctagggcctccagttccggcgtgagagtctgggagatacctactcccgagctgcccaatccggggctgggcagatgacagaaccttgggagctgaaggtgactgatcgtatttttggcggcatcagagataggtggctatcacagctgctacaacccaggctcgcgtcatccacccccctacttccctccctgtccctttccaaaggaatcattggcacgagtactgaggaacatgccgccaatatgagtaccaaaagtacacaatgtggtacgttgcgtaggggggggtgaacggatccttcccgtgccgtgcctacaggtcaggcatatgctggaagcgcaatttcgtcacgcggaatttttttcttttgtttaaaaaagaaccagaccgggctgccctgcgtgtgatatcggacggtggtggagggttgccatcgatcagggacttctgctcggcggaaagtcactttctgcttccgtgccattggttctcctaggcctccaaggaatttccttttgcctgcgttaaccgggcgcaattagtgacacagtagatactggtcgttttcctggtcaatacggctcactcgtctagtgctgcaccagcccacaacctgagaccagcatgcgaaagtgacagaggcacggatgtgtaaatatacgcagacgggcagggtggcaagtgaaagtaggaacttatcctaatgtagtgatgatcgcgagagatacaagagttgactgaggttgcaaataataccgaccctccttcaagactacctggacatcaactagccgcccgcaatggtcttagtcctctattgtgagctcggaagagactgtcgtccaagaaacctagcgaggcaacccgatagtctgggtaggagttaaactagttgcgtgcatagagcaccaccaactcaacaaggttgcccggcttgttggtcgggttgtgatcggcgttgagaggcttgcagcaagttgctgctatctcttcttttgtcggaggctgcagagaatgcgtgcgtgactatcgccggccgctgccttgaatgggggtgtgatcggttggttgatcggacacgcctccaacacgacagtgtccgtattcaacccgagctagtctattgtttcaatcatttttccttcgcgtgggcttcaaatgatccagcgactattgtgccgtcgggcaagatgcgttccgtgcccctcacataagccaaggcaaaggggtaagcaatgtcacacagcagcgacgtgccaatgatgatgcctgaaacaggatggaagataaagccatgggcttcgggccagtaccaccacagaagaccacatgcaagagggagtcccatctgcgatccaacaaaccggcagaacctagacgcacacctgttagcccgaccactatccgagacaatcatggtcacgagccgctcattttaactcattatttccttttggccgctcgtgctgagtggctggcttagctgcaatggcccgaggcgactggattgaccggtctttcagctgccaacaacaatgacaatgaaacgcgaccaacacacggcgaaggcatcgggcgtccccatggttatcagcgatccgataattctcggccgccgccatacatcctacattgtgtgcggacacgttgtggaggatgtgcataatttgttggtgatagtgacgggatggaagggtagatgcatgagctgagcgcctaaatgggaacaaacgtaccagattgcataactctggccacccgaatggccgcgctggagtaccatggccaaagaaccaacactgaaggccatctgcgctgtgccggccgcccaccaagacagctcggttgtgtcgcgtgcttcctggccgaaccaggtcttcccccatttgatgccatacccccgatgcggttccttgagccaccaccacgcaaaggacgcgttggccgcgacaccccacaggaacacaaggaacaggatgagggagaagcgccgagcgatgagcggatgtgacctgagggagcgcggcgcagcgcgaagcgtcgcgtagagcactgggacgtcgaagaggagccacagggcgaagccaagcttctcgaggatggagtcggcgacatagactacccagacgacctcccaggcgagattgaccccgagcgcgatcaggggcatgggcgtgtctcttgtctggagcgagcgctggaccatgaggacataagcagccagccagaagaagacgcccaggcccaggcagacggttgaggccggtatgagccaatccggcgctgatgggggtggaatatccgatgaacccatgattctaatgttcctgaatttcctcaatctgggatacttttgacttgacgatcgtgatgatgtgccaccaagttcactcaatccatggcgtattttttgaggaagtgctgacctaatccacctcaccgctcctgcctcgtgttgcttcgcttcgccagtacaaaaataagcattgcaggaacctctttttattggcgctgtttcactgagattagattcttaattcttgttttactcatttgatgaatctgtttgtgggtgataacgtagagtggctggcatggcatcgctcaactcccactaggtttcagaaagaactgaggtgcccttaaggaaaaagtttctcattaggtagatagtaagtggtctttcttcttgtgaatgataataacataataagaaaataataaagtatcccctaatatttagcttatattttcattattgctaggttgattattttgatattgtgtcaatatttaatactggaggttcaaggtgtgccatgtttttgtcagtcgcttgggtggctcgaagcatgagtctgatgttccttctgaaatttacacatcattttgataggttaatctctcgttgttgttagccataccatgtagagcttcgaatatttttgtttagatcagttgcatattagaaggacggcgcaaggagttggtcatcccctcaagtagatgcaggttcaatgacagatattcatttttctgcctctagcattggcatcttatttgttttccgttcttcacgtggcgtttatgagatatgaagggagataaatggaggaggaggaggatcattttgtgtcttagatcaagctagaaacaccttcaacccaacgacattttaattccaccctctacccccagaggctcaaacagactgttatgttgcagaaacccattaattatgactgctgaagctcaaggtggaacgaccgaaggatgctgtccgtatcatcaatggcaaggggtctaatatcggccatctgcttgatcttggcggtcctgtttcgctcttgtcagcttccgtgcctcaatatggttcaacgctcgaacttacacttccttgacctgctcatcagtcatactgaggcccaactgctcagctctcgagcggacggcattccaaccggttctggccaatgtcagtttctattcacatctcggtgaaagttagtttaagcgcggcttacatgcggctgttgatcgacacgtagcgagaaagaccgaagacctcgggatcaaggatctcatatgtctcgaggaaggtcagctaaaatgggtatacttctcttcatatagcaagattcttaccgaagggttggcgaggatagccttggcgtggatgccagccttgtgtgtaaatgcgcaaaagcccctgccacaatattagtctcgagccaaactttcttagcttgggaagagcggtgactgacgttaccgggttgttaaacgggatattgatctctactgcatcggccaccagagtctcaagagccttcagctccttgaggttgtacttggactttgtgtactcgggggcggtaacaaccattcttgccatgaaagcaccttctcggattagcaagagctcgattctagtttcaagattgacatacccaacggcgtaatgccgtttcgctcgcctagttttgcatgttagttttgtgcggaatgtctcgcggcttgcgggttgctcaccaatgccgaggacggatgtgtcaacatgcgttgcgccagcctcaagtgcacagaacgcatttcttataatggcttatcagtaccagtgcccaaaactcataaacaaccaagcaataaaacttacgcctatggtcataaagcattgacatcagcaaacgaaagaacgtatgtaaagacttgagagaacttaccactgagcagccagtatcgtcatggaactactcaaagaattagtgacttgatgggggcctagattagcttctcaaggacctacatggcactcgatatcgcagccaacaacacctacacagccaatcaattagtcggtttcttaggcaagtccaaacaccaaatgcctaccacgaagagtgcggaccacgtcatatgtcatgcgaggagttgctgaaatcatttagttagaataaccccgaatgtcggaccaatcatcgtgagtgtcgacgggaaacgaaaacaaggaacgcaagacctacccccaccgcttctattagttagcaaatcgttcacttattcacctgatggggaaactaacacggtatctgcaataccaacgcggtgcacacctgctctatcgactgccttgtagagcgagagaatatcaaccaggtcagaacggaaggagtcctcggaggagaatcggatctcaacattttggctgtaaacaaatattcggtcagccttgatacccggttactgcaaattgacgtccagccgtgagaagctgtgccgccaatagaatggtgttgcaatctcacctctgtaggtatgaaatcacctccaacgccgtcttctggatcatctccatgctctttccgtggctatactctcggagatacctcgaggtgccgatgaccaaatctacaccatctactcctgcctcgacagccctcttggcgtcgcccatgtggcaccggacatgggtaagaatcttggccttgaggccgagattggagatggtcttgcaatcctggaacgactgctccgagctgcaaggattcgtaagttcgatataatcgacgccgaacgaatcgagcgccttggcgctgtactgccgtgttagcactgaaacgcagccgtgtgacgatatagaaggcgaccgggagcagcccatacatcttgaccttggtctctgtgtcaaaaaagctattggcgaactgttcaccttcgcggagagtgctctcaataatcttgtagctgttcacattggagatatagtcctggacggcctggtagggcgtggccgggggagcccgctggctcggcacagtgctgttagattcctcgttcccgcacattgttccaatatatggagaaaataaattgggttgatttcttgttgggggaaagtttaagggtttcggcaaggaatagctgaaatcagatggtggatgagcttcaactctgcttctttttggacagtacagaacttcaactggaaggatggccaagcttttatacttcacttgtacctgaactatttctcttagagtttttatacccaccggcttcccgtaaactaagtgggaatctggggccggcatgatggatcgtggaggggccgcaaaccagtcatccatgccgatggcggcggattttggtgtttcggcggacatccgacgaagtgactcaagtacgtgcgagcccagggatattctcaagacctgcgaatgactcatttgccatatgtctaagtcaatttttgaaaccatttgcagtctgttggcatttactaacatgcgcgctggattggctcctctgtgcgaggctcaatttgacttctcaagggtcccataccaccgaaccagcgatcactcgcgttaaacagagtatcaaattcaggccaatccgtgacacagtgtactctgtctccttgccaatcatagtgtactcgttcgtgattctgaaggtcaattaaaccccaattttcaggatggtgcgacagaaattggcgcaatttggtctacgactgacataaatgttcacagatgagggagagccaagatttgaggaatcagttctaccctcacggaacacaatccgagcaaatgattatccgtatgactagagcataccgggaacaaattctgagcaaattacatcttgcgttcaaacaatatacctaagcacatagatcatcatatatccttgtgagcctcaaggccgaatgctaatcgcttgccatcaactctgcccccccccaaaaaacatcatcttgtgaaatcaatgcacatttccatccaacacgaccaacctgccaataatctttcgtgggtatcactcgataaaacgtcgcgttattacatattcaagccttcccaatcataaaccatcattcatccctccacttctccttcgagtcgaaactaattgtcagccttagtcttaggtgcgtcggagtcagcttcttggttgggcgttgcagaaggttcttggccctccttgccactgtccttcttggtagacccattctccttgacttccttcttcgtgtcctcgagctcttggatcttcttttccatggcagctatcttgtcaagcgcgcctttcttctcatcctctactgtcgatagattgatctgggcctcctgaagcttcgacatgatttcggtttcaagccctttggcggtcttgacctcatcttcagcagtttccagcttcttttgggcctcctgaagctgggctttcagctcagcgtcctctttttgggactggagagcttccgaatcgagctgagaaatcttggcttcgagttcagccttttcctgtttattggtcagttgcgacacctagaagtcttttagatcttattacataccttcgcctgagactcaatcccttcttctgctttcgcgaccttgtcctcggctgcttcgagttgagaagtgagctccgacagttttgtagtctgctcttcgtgcttcttctgcaattgttcatgctcgtcttcaatagccttcaccttctcactgcctgcctcgtgctctttgagactagcctccagtctctcaacctgcgactcatgctcctgctttaaagattcatgatcttcggacaattttttgagcttcacctcgaatgcttcggctgccgcctttgcatcattcagttcggagttcttctcagtcaggctggcttgattcttctctccgatctctttgagctggtttgttgccgcctgagcctctcccgtaagagtttcatgttgagtttggagagaggcgtgcttctctttccactcatcgagctctttcttggcagcttcaaggtccgaggacccttcattcttgagcttttcgttggcattctcaacttctgataagctggcttgaagcgcttggtgtttcttctccgcttcagccaactccgtggccagtgaatctgactttttactcgcttcctcttgagcaagctgaatggcgttgtgtttttccttccattcttccacttccttgcgagcggcctcgagatcagcagagcctccagactggagttcctcgttggctctcttgacttccagtatttcagcttggagagcctcatgtttctccttcatctcagctagctccttggaaacagcctccgaagttgtggtcagggtattctgcgccgcttgcaaggcctcgtagttctccttgacctcagcaagttccttcgctgtagcctccgatgtttcactcaaagtcgactgtgtggcctcaagagcgccgtgtttttccttccactcctcagcttccttcttggcagcctcaaggtcggcagcgactccagattggagcgcttcattgagcttcttgacctccaagatctccgtctgcagagcttcgtgcttctccttggtctcggcgagctcctttgctgtggcttccgacctctcgcttaatgttgactgcgttgcctcaagagtactgtgcttctccttccattcttcgatttctttcttggcgacctccagatcagcagaacctcctgatttcaaatcttcgttgagtttttccgcctccagcaacctagactggatagaatcacgactctccttgatttcattcaactctttggacgcagcatcggaggtcttatgcaaatcgtcataggaagtctgcagggcatcatgcttctcccgccactcttcgacttccttcatagaggcatcgacgttggcagatgagttgttcttaagttcctcgatggctttttccgcctctagaagtttgctttgagttgcgtcccggtcctcttttatgtcatttaattctttgacggcggcatcggatgtcttggacaggtcctcattagtggcttggagagcatcatgcttctctttccaggcctccaaatctttccgcgtagcctcgagttgctcgacgtcggccctttgctgttcccgatccttctcaagctccgcaagctttgcctggatggcttccttctccttatcagcagcatcaagttgcgctttcgtactttcggccaaggagtcatgggtggcctgaagagcagtgtgcttctccctccaatcctccagctccttctttgtagcctcgagatctgaagaactaccctccaatgcttccgaaagctttgattggatagacttattttcttcctcggcatcagccagctgcttcttcaaagcttcgagctctgacagatcacctttcaaagacccgtaggctttttccaggtccgataacttcgactgaatcaagactgtctcgccttgggcgtctgtaatctgctgtttcgatgcctctgcatccttagccaaggtatcatgggcattttggagggcattgtgtttctctttccactccagggcttctttctgtgccccgtcaaggtccgtagttgcacccttcctcagttcttcgttgatgccttccagaccggccaacttagcattcaggtcgctcatctccgccttgtgtgacgacaactctgcctcagtatctatcttcagtttttcgtaggcctcctttgaggcctggtggttcgactcggcatcagccagggcaactttctgctcctccaaagccttttcagcagctgcgagctcaccctctaacttagcggaagcctcctgcatcaatgattgcttttcttctgcctcagaaatttgtgcttttagtgctgagatctcgtccttgaatgaaccctccaaggcatctcgttcttccttgacctcgagcagctgtttctttatctcggtcaattcatcaccgacactcttgcgctcttcctgagcagtctggagactttgttcagactccgcaagttgtgccttaaggcttgaaatctcatcctggagcgaagaacctgcagcgtcttggttttccttcagcccaagtagctctttggaaagtgcgtcgcgctcatcctcaacggccttgagtttctgctcgacatcggccaattgagctttgatggtctccagctcctccttcaacgcagagtcggctgtgttggcagcatcgttggcgtcagccaactgtttgctgagagaatctcgctcctcctggagtgcttgcagcttcttttccgcctcggctactgaagctttgagagtctcggtctcttcctttgctgtactgccctgggcttccacgcccgattttaattcagtcaaatcgttggtcagtgtcgttcgctcggcttcgatagtcgccagcttctgttcagcagcggcagcctggagttctagctcggccaccttgtccttcaacgggccttctgcagcatctctatcggcctggagagcgcgatatccattgtcggtctcggcgagtctgtctttaaggccggcaatctcttgctccagtgcagcttgggcactgtcgcgcatctccttcgcttgagtaagctcggcgcgcagttgatcccgctcatcctgggcagcgtggaacttctgctcggcctcggagaccatcagcttcagagattcgatctttccatcattatcctggttttcctgagccatttgctccttcactcgctgcagctcttcctcgtaagggtttctaccctcctggaatgcctgcagctgctcctccagcacggtctgcgctttcttggattcctcaagctcctgggtacgagctgctgtggtttcctcggccgcatcgttttttgccttgaattcctgctcaagttcgacgagaaggccagaaatttcatacccatacgcgacgcgctgggctttcaactccttcaattgctttttcaacacttccgtgtttttgctgagcagagagcactcattctgtcttttgagcaggctcttctctaaggaatcgatggttgactgtctgtcggccagttgcttctctagatcctccctggcctctttcgagattccttcggcatcatcccgtcggtgggtgaggaaactgactcttctcaacttccccatatcaaacaatgtatgtggtggtgtctcccgtatgcgcggtagtatgaagaactgaaatggtgatggctgtactatgtatagcagcacgggtatataataatgacgcttaggttccttgtcaacaagtaaacccgagcgaccaagcggatgacaaaatagaataagaaaaacagtcgtcggtgtgtgaaacaaattctaaatggtttaactggaggggttgcatcacgcatacacggaaagctctcatcgtcttattatggcccgaactgggctgcagccactattacatcgttgggctccgctcgctcacctaaaccgccccggtggagaaccgaagtgtactggcataacgcacatcctatcaattgcggtcctgcagttcgtggaaatcccttggacaaggatggcagtccttgattcattttctgatgtggtccctcccagaaattcggtgtctaggacgcattcccagaggcccatgctgcccaaaatgagctgcataaacgcgggagatgcgatatgataagcacacgagcaaaatgcagggaagtacccaggcggacaaggaagcactggcaggaagatgatcgctattacatgccactaatccggggcattggtcccaagcctttcatttcgatcaaggctgacaatgtggtatagttctcaatgccgtcgcccgagcgttcataacagcatttgaaaccatcagttaggacgaccaggcgaaaacgctcggccacgatatggcggtaaactcataattgacgcagctgagctgtctctgattcatgttcaatccgaaacactagcattgaaaggcgtcacagccaaaatcaacgcggcatgcttcaaacagccagcgtgcttgcttgctgctcggcttgcttgcctggcgccatgacttgaggttgatcccggcaaaacgctagcagaagcgccaacagggcctggacggaccccctgactgacgtggcacctgtcaccatatgcccggacaacacaccgctgtcaggtctgggttttcgagtgatgcaacatgctgcccaacgaccctggcggtgcttggtaagagacgatgagcaaggctgtcacatgcaagccagagatggccagatggaaatgaggagaaatactccgtccaagaagcatggcatcaatcacatcagtgagtgacggaggagagtaaaagcaaagaccctgcctctcagcatgcatgaacgctgacgggagcggtggggccacttgcctccctgtgctgctgccaccggctggtctttccctcctgcaaacctcttgcggaaaggcatggattgagtttgggcaggtaccataactgacgtaacaagctgatgtactcgcctccttctactcaccttgacctctcttttctcctaccctacgcctcaccctccctaccagcgcactcagacagacgtcaggcacaacatgatcaccactccgcttcctgaccgactaatggggtggggcttaaacaatcaatgcctctgtcgcccaactacccctttgagaagggctagccttaggtgtccaatgatgagtatgtagtaacgaagtcggtatgtttcaccaggctaaaagtattaaaccacgtagacgtctcactgtttgacttggctgccaactcaacaggagaaagtgcctaaccatcggaggggaataatcaactgtttagtagtgatggccagagcggcctgaaaagcctgaaaggccaccaaggcagtcctaagcgttcaggtgattcagtaatcctgtcatgtgtggtctaaacatgcaatcgttagccgaaataaatcatccgttcggatcattccagtgaaacacgcaagttgtgcaataaatactagctacttacatattgatcttagaagctcatcatccggtgtcgaaagtctcttgtcttttttccacatcgcgtgattcaaccctccatggccattgattatcaacgatacttggttcatgatttgaagaaagttcagacgcaaaccaatgaacccaaacaagcgactgacataaaacatggcacacccagaatctccagcgatcaatttcaaccaaacaacgtcaaaccaattaattagtaaataacacaatgtcgagctaaatattgtagtataacaatatgttatcttcttagtattgcgtttaatattattgataagaacatgagatccctgacttgcgtgaacagagctttggtgtgccatgttttatgtcagtcgcttgccagataaataaccgctgtagtcaattgataaaatgacaggtcacagggggaaggtaacgaagcaaaaataacataacgttcctcattcaagtagactaattaaataagacatgatgcaggttgacaagagcattagccaacagaaaactcagccatcaaaggaaaagggtataaaacaaagcacaaaggttgtaagaccgcgacaaccatgatcaaaattactcctccggactctgagagacatggataacaatcttacccttggtatggccctccttcagtttcctaaaagcatcgggaacctcctcaaaagaaaaagtggaatcaattattgccttggctttcccttcagccatccaatccccaatcggatggaggaactcggagctgttgttcatagtaagaaatttatagcggtggccaccgaatatctttggcagcacctgcctcttcactgttgcagccattgtgcccatcgtcaactggctacccactcccacttgataatagacgccgtgaggcttgagaatgctgccgctcgcactgtacaagtcggcgctgctccctacattgtcaacaatgaggtcaaagaccttgcccctcttcttcaaatcttcaatgacgtttgtcttcttgtaatcgaggacctcgtctgccccgagctgcttgcacatgtcgacattccccgttgagcaggacgtgacgacgtcggcaccaaggatcttggcaagctggacgctccaggtgccgacgcccccgctgccgcagttgatgaagatcttggatcccggcttgagcgactttggcgtcagcgactggtatgcggacgtcgccgccgtacccaccgccgcggcctggtccggatcgaccccggagggcagaggggagcaacaagtgccgggtatgacagtgtactgcgccagtgtcccgttcttcccggggttgttgaagcctccaaatacgagctggccggtctcgaaggccgtgttggaagggtgtttggcgataacgcggccgcagaaatccaggccgggcgtcgcgggccgtgggatcaccaatcgacccatgaggccggactcggccagcttatagtcgaggggattgatagcggccgagatgacctggacaaggagctggtctccggtcagggatgagtgggcggggatgggtgcctcggtgatggtaaggtggtcttcaagttttccattgaaagtcgagtactgccatgatttcattgtatcattggccatggtggatttagatgccgagtaatttggcgttgaaaataatatatggaggaatgaggtacgattatttatcgcggtagcatcacatttggatggtcgtaaaatatgtcaaaacactatctacaaggaaaatccagcaattgctcaaatatttaatgcaaccggtgttcgccacgacagctcggcggttgatgaattgggagtgtctggcagatgacctcgcaacatcaggccaccacgtggacaacgggtgcgctaccagcatcttgctacgaggccgggtacgtctccaatgacgagtactgcactgaatatcatcaaagattttgagcttttcgtttgcttccttcaccaattcattggctgttctacacaaatggctacatgctcatatttgttgggcttgttgcgtggttatatacctaggcaatagggtaggtgggaggaggcggccgttgagatgccagaccgttgagaccgggacaatccgacttggcaaacctaatttcataacaatgacatagcctgctcctaggatattctagggtgatagatgagcctgctcaaaagatttctgattgcctgaatgattcttctttatgaaagtggcacaaactcgaggattgattcgaaccgttttcgagtcatgttagagccagtgccaggatatgtcatcatgcttatcctttaagcttgttggtccactgaagtcaccttacacactaggtataagcttagaagagcatctccttcgaccggtatcaacgaagcagtcaagatctcagagctaatttgaagtggaaacatcatggtttatatatatccgctggaagagaatctcctccctgttgctctatgggactccttttgtgacttttccaagtagcttgttttttgtgcaggtattttgatcggcatccactagcaagggcactgcgccaggtcgaagacgcagcggacaagcaatcatccaaaggtgtgacacggaggagaaaatgataaccacgcttttcaacatcgaggaatgcccgtatgcaaggaaccaaaataaaatcgccccaattccttggcagatcggtccgtgggtagacgaatgattcccctgggaggagacagcatgattccatcgctcgcccagagacatatgtctcggattggattgggtcttcggaatggcccagcgaaccaacaatggggcgtcgtgtcccgccctcgaacaaaaggtcgcagcgtgtcttgcccgcttaggtaggtagctggcgtgttccccccgcagagagaggggagctcagatgaatgccgtgcttctgcctggcattccgccgcccagctttgtttcccagctgccgtattcatctagctcctggcgcgactggccaatccttcgatagctcactgctgatcagcccgcccgaatcgaaattcctcacacgacatatcggcatctgatccctgctcttctctatgggattgttgagccattgattaacgcgatggcgcaatcaagtgctaccttcagataggcaagataggtagatagaagattagatatatacacaatgggtcgtgatgcattcctctggttcacctctccccgtcgcgtcctcccttccctttatctccaaggagtcaattggtcaaccacgcagcagcgcggcacatcctctgagcatcagtcattcccattgaggccggcctgcgcgttccgcagactacattagccaccatggtccaactccggtcgggtttcgtccctctgctcctgtcgctcctcaattccctgccttcttccaatgcggcgccaacgctacgttcggctggggcccggctcggggctgtcgcttcggaggtcgatgtctgcagtgatgtcggtactacactactcaagcatggtggcaatgccgcagatgccctcgttggtaccgtcttctgcgttggtgtcattggcatgtaccacagcggaatcggaggaggaggattcctgcttgtgaggtcgagcaacggaacatacgaatttgtcgacttccgcgagacggctcccgcggccgcctatgaggacatgttcaaggccgacccgaaccagagtattacgggaggattggcgaggtgagttcatgccattgtctcactcaatggcttgcaggcagtccgctctcgtgacatatgctaactcgcgatagtggcgtcccaggcgaagtacgtgggcttgagtacgtccacaacaagtacggcaagttgccctgggcagacgtgcttgcgcccgccatcaacttggcccgtttcggtttcgaggtcaacgccgacattgtcaggtacatggacagcgtgagcggcaacagctttctcacagacaaccctacctgggcccttgacttcgctcctcatggtcagcgcgtgaagctgggcgagaccatgacccggaagcgctatgccgacacactcgagatcattgcacaggagggaccggatgcattctacactggtacaatagccaacacgaccattaccgccctccgagctgctaacggcacgatgacactggaggatctcgcaaactacactgttgctctgcgcgagcccgtgtcgattaactaccgcggccgcaagctcacgagcaccaacgccccgtccagtggcgttgttgccttgagcgccctcaacaccgtgagtggctatgatgggtttgacgatccgtctcagctcaacctctcaacccaccgccttgatgaagcgattcgtttcgcatatgggcagcgcaccaagttaggcgatccttccttcgttgatggcttggacgagtacacacgggatatggtttcccccgaggccggtgaggagatccgatccaagatctctgatttccgcacccaaaacgtgtcctggtacaaccccgatggccttgagtccatcgagactcctggcacatcccacgtcgtggctgccgacgctagcggccttgccttctcgctcaccaccaccgtcaacctcctcttcggctccaaactcatggtccccgagacgggcatcatcatgaacaacgagatgaacgactttagtatccctggcgtcgacaatgcgtttggctacatccccagccccgccaactacgtccgtccaggcaagcgccccctctcttccatctctcccatcatctctgagcacccagacgggcgccttcacttggccgttggcgccgccggtggcagtcgtatcacgacctccaccattcaaaacgtcatccacgtgctcgatgagggcctgacaatcaaggacgcgttggctcgaccccgtttgcatgaccagttgtcgccagacctggtgtcgtttgagtacagctacaacaacgaaaccgtgtcgttcttgaagtctcttggtcacaacgtaacgtgggtagctcccggtcagagctctgcacaggggctcgtgagactcaagtgcggaacattcgaggccgcaggagagcctaggcagaagaattctggaggttctgttgcttaatttagcgcggtatcttgggatgttgttcgttcatattgtacactgttagcatatacaccattaatctgtattgtcgtctcactcagtaacggccgaattgatagagtcaaataataagctggacatagagatctggaagtaattcgaaattgcctccgcagagtgaccgatgagaactgcgaaatcatctttaaaaatgaaccaaagtgagatcatccatagactgtaaaatagctcaacaatgattgcacaggcctcattttccaagggcatgagcggtcaagagaatgattgaaaacgggtgtgattccacgatcatcggcattttggtaataataattattcatccgttcttgtgagtagctccttgtgtcgtgctcaatataacttttgaccttggcctcagatccaaggcccaatatctctccgtccaggtgtcttcgaaaccatctggctcatggtgatgattcttcatatgccgagcagggccatctttgtggtgatgcctggggaagcggtgagagctctctgccagtcgcagacaatagcctcttccgaaattgagcatcaaatgcgtctcaattgcattccatttccccaagctaatcacggctcacccctcacgcctgattctcatttgacgcgctgctctagcctgacatggtggcatcattctgctctccctcaccagcaccacggacccataacacgttgttgcatctacgccgcggttagtttgcacttacgctgaaagacgaatggattagagcgagacataatcaacataccgaatcagtacttggcccagtgagcctgtgagcttgcttgagacgtactcctccgtacctgacagctgcaggttcatgtagctgtccaccgcgactagggtgcctttgtactcggtctcgccccacttcagtcgaacaagaatggtcttgttgacgagttcttgcagcatgggccgcgggttgacggggacgaagctcatcttgatcgcttggttgttgtgtgtggatgaatttggcgacgacaattgagtgagcctcgttcttgtgctgcaagaactgcctgcctccgtggcgcgtgcgccgagattttagcgtggctgaggtaatgggaaaaatactggcggcagttgggggggaatatgagtcacgtgatctatcacatgagcacggacgaagaccagcatgaacgatatatcgttcatgctagtgtgaatagtgggcaaccgcgggtaatagtgtcgggggagaacacacagtgatcgaaggactgccaaaatgagatgcagtgtaaggcgagattcattgaggtctgttgtgccagcgtctcagcgagtgctttggcctgcacagtgcttgatggttgcacggtcgccggactcgtgcatggaacctatggcgcgaagctttggttgattggccacggtgacgatgacttagatcagcaggcacactggcgagccaaaccggggtaggggtgtaactactaacaacttaacacggaactttattacatgtaattatgtgcagccagcggattgtggaggacagctccaggcccccagtctatctttagctctggtccagaggttggtagccggcgactcccacacgagcacaggcaaatatgcaagcgcgcgtaatgagctttgtcggcccagattttatttgccaggcgaggactgctagatcggaaattgagttttccctttcatttcccaaatccccagttcccttctcgcgcatccgccaagatccccaagcctcccaccagtaaacagctcgagacgacatcgaagcactcgccacactcgactacaccacgggcggtgaccgagggcagtattctttttgtctgccgggccgggcgaaaatcacaagaaattgcggctcacacctgctaacaccgcttccatcccacccaaaccactgagacccgacagcacagcgggtctcgtacgttcgtcgttggagcggctttgcttgtgcgcgtgctttgcaggttgcacacctggagcccgagctgcgaacttcctcgaacgcggtgctcgccaaacaccgacagccatttacagccaggccacagctgtgccaggcccgcctcatatagtcagcgctcatgatcgctcgtgcctggcggtctgggaccttcactccgaacgcagcgtgatccgtcctatctgcaattttttttgggggaccccagcatctcgctctccctctgcctgaccgccttctacgttgggtgggacgttgtggcccgagcgccacgcgtaaccaacttgtctctcgcggtgccacacgctaggctaggtaccttgtagtacctgcgggctggcccatcgtgcgccaccgcttcccgtagagcacgggtacactgtttctcaggctcaggcagctcatcggtctcagctggctgggtgttgtgcctggatcagaactggcccgtcttgacaggccctgcgagtccccggcccatcagaaattctgccgctaagctggaaaatccggatcgccaattatggggaccaggcaatcgccttcaccctaccacaacattccccatcctccctttggcccagctccaactccaacaccgacctcgcatcaccacccgtcgcatcctccgcacgcgacgtacgcccacgggagccacagccctgtgtatgcgcctcatactcggaccccgtcggatgcaccgccctatctgcctccggcagccacaaacccacgatcgtattcatccgaaccgcaggggccagcgcatcattcgcgtgcgctgagctcctcttccttgccctcaggtagagaactcggtcgcgcgatgccaccccccaactctcctcctcaacagggggtttcgcatcaccagcagcacccgatggcacaacaaccgccaccccaagcgcacggtatgggcggttttggtcctggaccaccaccgcctcgggcgccgctcgtcgccctcggacccccgtcatcgtttccatcatctcgagaactccctgcgccaggtccggcatcgcgtgcaggaagtacgggcagctccatgtcgatatcatcgctcttgggcggcccgcctccagctcctcgagagccaccacctgcaggtcaacaacaacattatgctccacactccgctggcccccccggctcggccccgaactttacaccatctgtccacgcttcgccgcggatgtccaccgagtttgtcccttttcgacgaccgcaaacccccgaccatcacagaccctacgacccgcgcgcgaatccagtgcagtcacctcggggtcctggcccatactctactacacctgaggttcagcggtacggtacgcctcaagcatatcactcccgccagccgtcagcaccgggcgatccttcgcgagatcctggaagaatgcctcccgccgccgcgcctcctcctcgcccgagtagccaaccaaaagcctttcctggcatgcgatcacggccgatcgactcgagagaccctggaccggaggaacgatatgctcgtcgagacgagttaggtaggccagtggctggaccagagtacaatcctgagcggacaggattgcgaccttacagttatgatgagcgatatcggccggatcgagagcgtcagggtgaactggaacaacgcgagcaacagcagcgcgagcgtgcattttcaggcggtgacattggacgacagcacatgcatccgcacgaacccccacgaaatcaaccgcctcagcaacagtatggacggccgccccccgactctagagaagcccgagatccccattggggccggcaaccaccagagtcgagctaccgggcgccgatggaacaccagagacaacactcagaatatccacactacccgcaacagcagcagcagcagcagcagcagcaaggtccgccatatcagggaccgcctcatccagatcgatatcctcccacctctctggccccccaacggccacattcgacagcaccaattcccccatacgactcacctgaacgatcgagggcgagcatgctacctccacaaccacaccacgagcagcagcagcagcatgttcagagaggcaagcccgtagataatcaacctcccctgggcccggtgccccctgcttcatataacaacacgcctggcacatctcacttcgacacttcccgacaccgccctaacgaggacccaggtgcgataggacaccagcggagcttgcttaatgtgctccacgaaaaccgcaaaggacgtatctctcctctcccccaggccgtccaaggcgcccagcctcagcaaccgggacatgccgccgaaccaggcattaagagcgaattcggccgaatgttttccggaattggcagtggtattggcggccttggtgtatccagcccaatcgcgtcttctacggtcccatttacgactgcatccttggctaagcgagaggataacgttgacgcacctgaaccggcggatgtgcctagcaagggagccaagggtaggagaaggaagctgaaggaagaagacagccgtgatgacgatagttcagatcgtctgaccccgagcaaggccaagcgtgctaagggtcaaccccatcatcaccatcagtgagtcaaccccccccacaaatggttcatctctgtgtctcgcgtaatatataacccattgctgacgattccttcctagtcatcatcaccaccaccaccaccgcttgggcgaggagctgattccaggaactccgccgttcaaaaatgtcaagggtggtgcaaactcagctctaaccccgggcgataaaattccagccccagctcaccatcatcaccaccaccatggaccacggccagctcagcctgctcagaacatgccagcgaaaccggccgcgaatcctgttcctgctatcccgcctcgaataaagatgtcgatctcatcacaagctgttttggacgcggtcgcgaagtatccccgacaccacctcggagatttcatctacgaagctggtttgaaaacgggtcgcctggtgccgaagacccctgctcacagaggattctcatccaatcccaaaccacttccgctggagatgattaaagggaagttgaactgcgtcttgacggttaaggtgccgcgtattcatctttccccgctggcccgtgaggagatcacttcccgcggctatctctggggcactgacgtctatactgatgactcagatgtggtcgcggcttgtatccatggtgggtggatcaagggtgaatggagcgaggaggtggacgttcacatgctggacctggattcggtcgctgagaagaaacggaagggaaaggaggaagtggtcaatgattccacagatctggactcggagaatctcatctcggccccgccggcgtccggcccgatgcgcatccctgaggatcgtgacctgcatgtaaacgtgctcatcctgcctaggctgtccaagtacgcggccacgacccgccatggaatctcgagccgtgagtttggaggcgatttcggtgcacgacagtctatccacgatgggctgagctacaaggttctcggtctacgctgggttgagaacggagctcagcctcaggcgagattacgcggcagagcaaggcgggaacgaatgcgaaaggcaatgcaggaggtcaagggcaccttccccaacacgaacgggtttgataaggagcaggagaagcgcctaatgggcgaagtttcaggaaactggtggaagaacaacagtaacaacggggaggagaggcacgttgaggaggacataaaagaccgaagggtcagcgacggcgacaaggagaaccttgctgaagacgaaaacgagtcttcagagcagccaaaggagcccagcgagggcaaggacattgagatggcaaacacgaccgaggaggccaaggaggctacttctgctactgctgtcacggaggcagagaggtgaacaaccatcccccgggtatttagatggggcaggatttttcgccattgggaaacgtgttattggcgttgaggcagggaaatcacaaaaccgggatttggtaatgatctttctgcgttatacaagcgagaaggcgatctgatggctacacatttactcgcgatatttgtaatactggataaatacccctttgattaatgttacatttattgtacactatatatcctcttagtcgtggaaacgtgatgtgaaaaattctaggttggggaacagagctctagttggaaggcatttgcctggtctgaagatgacctgacctcggctatgcagtgatcgctgtgttggcgcaattattctttttagaagtccgtgactcgtccattgtagctccagtcgctcttgtccccccacctgagaggctcattcttgggacctccgacctcgccggtcttggggtttacctcgccgtcgaactcgggtttggcgccacgccagagaccgccctcgcccaattcctcggcggctgggtcgactgccttcgcagcggcagcgctcttttctgcttctagggtctcgggctggaaggcgggcgacaccgcagcttggcgctggaggcgctcgaactcggcttgttcgttggccggcagcttcggtgggccgggctgggaggagaagggcgaggaggagtagctgcgcgtgctgagcactctggggagggagcgcggggcgccgcgggcgaggagtatccttgacattatgcactgctgacagggtcggctgcagatctggatcctgagtctaggttgtcgaagggattggtggcggatatcagatcgcctccaagtactccagatagcgcatggagattcgctgactaagaatagtcatcggacaaactataaccctgctctagggtaggtagctgaccgcaaagtacatgcacaagtgcagcttgatgatggccctagagtttcaaaccagggggtttcaaagcctgtataatgggccccatttgcacatcctttgtgcatgggtcgagtcaagatcggatgtaagtcacttcttcttcatacacaggcatgatgccgagctcaaggcagccttcgggcaatgggccaggaagaccgcggtccttctagcatctcgggtggccaggcactgccgttgcacgacacgaatagttgagagccgcacagcgccagtacgtaatcggttgcgctttgtggaagaatcccagacgaagacacgtggatgtggtctctcgcttctggaagttgccaggcgtcaagctaatcacctgcccacgtgcctcgtctctgcttcgacaacatagatcccgagtggcttcatcctgtcagcacccatctgcccattctgcccgtgttggttcgtgcttggcagttgcagtcgtcagccaaggctgaagaggacattgggagccagaagccatcagcggccgtcacgggcagacgagctggcttctaactgggcaagcgaaccaccagtgcggtggcatcggatgtgtggtccagcgggtggacagccagaggaaggaggaatgagccttgagcgcaagatcggaattgcgattggctggggattttgctccaagcagcagggtgacgccgctgccgtcgtccgtgctggtagagattgacgggacgggggtctggccgtggatcgctcgagcccgtgctcaaatccggcaacgccattggcccctcatcacggccgactcatcagccaaaccccgatgaatggagaatcccccaacgttccgccgtcgacatgtgcagactcacatacacgagtgttccgtctcagcctctgtgctggttgggtggcttatggtagtatcctgatggatgtgattttcatgccaaaaatatcacactgtctcagagtttatgccgatgggatggcctcaaccttgggctgacggccgaagatagctgcttcgcctgcatccagccattgaagagctgttttcaaggcaccaggccgatcctcgagtggaccactagggcgttttgtcgggtagaccctgccgctcctaagcttgaaggactcggatgtggtggagcgactatcgatcacgccctgtctagatcgtgggacgttggtgtggtctcctttgagcaccacccttgccacttcggcttttcaacttcacatcgggctgacagccctttctttaaggtagttggctcccggtcgactgatctctcacatcccacttccactatcgtgacgctgctaccacttcgtctgtctgatattgacctcatgatggacaaggaccagccctgacacaggacccgactcattgtcaccgctcgcgcgccgcattacgagactcccagcaagagataccttgctctagaactctatctagttcgttcttaacgacgggggaatggctctgtcgaggctgctgcaatatgccgactcttcatcaatacgattacatttttgctgtatcaactatcttcgccttccttgatgcctggaatattggtaagaatttactgctgctgaactgcaggcaaggaaacctgacagaaccgcaggtgccaacgatgtcgccaactccttcgcgacgtcggtctcctcgagatccctcaccttgaagcaagcgatggcaattgcctcagtttgcgaatttagcggtagcattgcggtgggagatagagtagcccacacaattcggacgcagattatagaccctcacctcttcgacgacgccccagcggttcttctcctggctatgatgtgttcgattatcgcatcatctctcttcctcacgtttgcgacaaggtatgggatgcctatatctacgacacattccatcgtcggaggaattgtgggtgcggccacggcctcggtgggcatcgacaagattcactggggatggaggggtgttccccaggtctttgctgcctgggtaatttcgccaggtatagctggactcttcggggccttcatgttcttcatgacgaagaagttcgttcttaccaccccaaaggcagtcaagagggccttttactcaatccccgccttcacattcctaaccgtcgggtgtatcgtcagtacgtattcacctcaccgttataaatgctcgatttgagtaagggctaaccagtcgaaagtgttgatcgtttggaagggatccgagagggacgcagaaacaccgacaaacatcatccttattgctatcttctgtggcgccggaggcgtggccgcattacaagcatgctttatactaccctacttatgggtgcgaatcttccgggaggattggaccttgcgatggtatcacgcctttctggggcccatgatcttcaatcgcccgccgcccccacctacaccttttggttatgtcaagcccaaaatcaaagactactaccgtggctaccttaccgccgaggagctagcgtcgttgcgggcctcgcagtctctcttacagtctgtacagacaccaaatggagaacaaccggccgagttgaccaaggacgacggaccagccgagctgcacctccccccgcctgctatcccggacgaacgaccgcctactcccccggttgaggtctgtcaaaacgatgccgataatttcatccctccgcgacccgctggcccgtggaatagctgggtagtcttgggatggagagttaatagacttttgcttcgagggatcgaacaagacgtcattagcatgcagaagcgcaatcttgtcctcaagtgggatctggaagatatgcacgcccgagctactcactacgataatagggttgaattcatgtactcgacactccaaatcctgaccgcagctgcggcctcgtttacacatggagccaatgatgtcgccaacgccatcgcgccattcgcaacggcttatgagatttggcgatctggaaaggtcgacgacatggtgaaggtgccaatctggatcctctgcatgggtggcggcgctattgtgctcggcttgttgacatatggctatcatgtcatgagaaccctgggcaaccgcttgaccctgatttcgccgagccgcggattctgcatggagctgtccagcgccatcacggtcctcatggcgaccagattgtcactgcccgtctcgacgacccagtgcatcaccggcgctacggtaggcgtcggtctggcgaatggagactggaagtgcatcaatcccaagcttgtggcttggatctacttcggctggatcattacagttcccgtgacggccctgatatcaggctgtctcatgggcttgatcataaacgcacctcggtggtgatctacatgcgccaaaacaaaatttcctacaacttactctaccttatttactacgataccccatgttgttacgaaaccgtatgatctgttgatagccaggagttgggttgggatgaatgcattttttggggtcccgatattgttttatgttattaccaaccacgagaggattcaaatgcctaggaggaccttgcctttggtttttgccttcggtttagaacaaggtattcaacaaggctggacatgttggatttgttcagggacttgcctttaggggacgctttttggctcccactcggcgttttagactccaaaatccctgttgtattataatatctagagaacccaggctttgattgtttagattataaagtcctttaccccttgaccggcctgccgacatgatgtgaagctcaagtgacggcatcgactcgagtatatgaaacggccttgcgcggacgggattgaatttgttgacgaactctatcacgacatttcattgctggccatggctacaacgggtaccagtacgagcagagagactattattgggacgtttaggtgcgtgatctgcgggagacgaagcaccgtgatgcggatcctatgaagcccacacgattttcgcaagggctggtgtctgatgggaaaacgctccaatggggagaacaaaacttggaattacccgcgtgagatgatacttggagattgggctcggaaatgatcgtcatggtggtttaaatgaagaaaattcgcaaacaaaaatgagctcgaatacactaccctgagaaccaaaaccgtattcaggctgaagaccgagatatcatattagccttggaggcgcttcttggatcaagctttgctgatcttccccttcctggagacagctaccgatgtgtcaggtaagatgacgacgatcatgaccggcttgtacctgaatattcatctgaaacacaagaaactggaccacgatgcatttagcctacagtaaaatccggggctatgcgacacggtaataggaacctcggcccgtcaccacgtttccgaaccttcattcaggcagtctgaggccgatcaagggagatcttcctccacgattctttaggatacgtgaaacggggaatcaagatgtataaagagtccaggattgacctctgcacaatcccaattgattctaccttcgacagtccaccacacattggatgatcaacatgtattcaccacgaacatttctcagtttcctgacagtggcatcggctgcttcaggtcaactccatgacctcgctgtcaaggctggactcgagttcttcggcactgctcttggagagagtcataccagcgattcagcatatatatcccttggcaccgacagcaatgaattcggacaattgacacctgaaaacggtcagaaatgggacagcaccgagcccagtcgggggcagttcagctacacttctggtgatatcgttccggggattgctgcggccaatggccagattcttcgttgccatactctaacctggcacagccagttaccaagctggggtgtgtaaagccttcgtcagaaatctacgaccatatgatcacgagctaacaacggggtatcaagtctcaagcggcggcttctcctacagcgacctgcaaagcatcatcgaaacccacattgccaacgtggtcgggcactacgccggcgcctgccaccactgggacgtcgtcaacgaggcggccgacgacagcggcaactggcgaagcagcgtcttctacgacaccatgggcaccgacttcctcgccatctccttcaacgccgccaaagctgccgatccatccgctaaactgtacgccggtcccccccctcaatgatccctactttgccaacctgtttgtgctgactcctccccttcagatatctgaacgactataacctcgagtacaacggcgccaagacagaccgcgtcttcgaggccgcccagatcatccagaacgccggcgcccccatcgacggcgttggcttccagggccacctcattgtcgggtccaccccctcgcggtcctccctcgctacggcgctgcgccgcttcacggccctcggcctcgaggtcgcctacaccgagctggacatccgccactcgtccctcccgccctccgacagcgcgctggtgacgcagggcaacgacttcgcgaacgtggtgggctcgtgcctcgacgtggacggctgcgtcggcgtgaccgtctggggcgtcacggacaagtacagctggattccggatacgttccccggccagggcgccgcgctgctgtacgatgataacctggcgaagaagccggcgtggacgagcgtgtccagcgtcttggctgctgcgacggctgcgccgtagaggatgggatagtagccttgtgatgggatagtcggatgcatctgtgatgatttgagctggagtgtaacagttgacccctttgcatataccttgagccatagtcattgatatggcatatgtatataagtctcttcgctttaagacttggagagataccagtcacagcgagatatttctgatgcgtattggttgtcattgtctacattaacacttcatgcaccccgtgtagtacgataaccttgagacccgacctagcgaatgctagaaaagaatatgtttttgtatttccgttgttcatccctcgtagcataactattttactttgttcactctattttccgcttccggagggcacctggaacaggattgccttgccgttggggccctgtcccgcagccttgtccacgcggaagtagcccttgcgctcgagctggaggaaatcgccctccttgagctcaccgactccagggtcacagatcgcctcgacaacggtagcggtgttggggttcaggcaggcctcgaagtcgtcgtccttgtccagggtgtccttagtgatgaggtagtcaaagtcccagagctcagcctcgacgagcttgccctcgttctcggaaagccaggtcatcttctgcttcgtagtcttgaaatcaccctcgaggtgcaactggagctggagctccttaattggggtggtgctcttgtcaagtcccttaacgatggcattaccccatgccatgagagtgaactcctcgccaagctccagggctgcggcatcggcctggtccatccaaaccttgttggcgaacctcacctgcttgttaccaaccgaggggttcttggggtgcttgggtcgctcctcgtagtaaggagtctctgggccgccctcaatagttgccagaacggcatccttcttatccacggcattgaagcgcggtacaatgggatcgagcatcttcttgttgagagtccagatcgtggtccagtccattgtgacgatgttacggctggggccttgcttaagcataaactcgcggagggcgggaacagtcagacctcgtcggatgataccacggacagtaggcatacgagggtcatcccacccagaaaccttgccgctatcgacaaccttggtcagcttacgcttggaaaggaaggtcttgatgaagttgatgcgagcgaactcccaaaggttcactcgtcggatatccagagcgttgaggaaccagtggtactgctcgtttcggtcagcgtactcggtggtacgcagggcatgggtcacgccctcgagactgtctacgacggggcaggcgaagtcgtatgtggggtagatgttccatgtccacccagtgcggtggtgtggtgcaggctctttgtcctggaagttggggaatcggtaaatgacagggtctcgcaaggagccgttgctggagtcgaacgcgatgcgagctcggatgcaatgttttcttccaagctcggttccctccttcatctccttaaagatcgccagggactcctctgcggggcggtctcggcgggcgctaggaaggcggttcatgcggtccttcttctggatctcggggtcagtgtcgtcggcgtaggcgtttccggcacggatcattttctcggcggtgtcgtagagttcctggaaatagtcactggtatgggtgatgcggtcgatcttgatgccgagaagcttcacatcctctacaattgaatcctcgtattcctgtttttctttggatggatttgtgtcgtcgaatcggacgatcagctttcccttgaaagcctcgtttgcgaaataatcgttgaggagggcagccttggcatggccaatgtgaaggtaacctctgcggagcattgttagccagttgtgagcgagagccatagatgcgtgggaaacttacgagggctcaggagggaatctggtaacaacaccgtcctcagtgttggtcagtccaatgttgtagttggcaccggtgttcttcttggggccaccgacagcggcctccttcacctcggggtgggcagcctcaatgtagttgaaccaacgggtgacactggcgaaagttcccttccgtgcaaggcccatggccaccttgctcttgcgaattgctgaccagacatccttatcgacggccgacagttcgtatccgttcaggtaggttcgcagggtcaagtgcttctcgagttggaggaggaggggctccaaggacttgaagtccgcggcagcaaaggcctcagcaagcttgtcgagctcaacaccgctcatgacttctctagatcgaaattttggtgggttgattttttggtgatgcagtgttttcgagccaaggagtggcgtgaatgactgatcgatgattttggaggggttgctttgacccacagcacaggaaaacctgtaccccgcagtacatccaagaggtacctctagaacccactaggtatttctccggtttccgcatcatgttttctagaccaactaaactttgacataccctatgcctgtccttggacaactgccctttcagcaagctatttggtcaagatgggttgttaacttccagattagaagattcaggggcgcattgataaatatggggccatgtcttgaaatgtttgattcttcttggatgatctatgtctagttgcttgatagcgttggctcttcaacatcgggtgttgcttcatctaacctcactttgatcagatattcctatatgcgcgattggccccttctggtattggattgaataagcatttttcaatcttgctgaacttctgtctgagcattgattgaagattctttttgggtctgtgtcacgtctattgtgtcttgacaatatggatggatgcacatgagctctgttttaatctacctaatttcatgagctggaatacttctcccatttccgcaggataaaactgaagcagtgcataaatcgagactcatatggagatatggggagagaaagtctaatggtagtccggctggcaaagcaacgggagcacatgctgcgggcatatctcaatctgggttggagacacaaaagtttctgatcacaggcggatgtccgcattggttattgcacagctgttacggcagtatgtaggcttgatcccatcagagatcccgatcacgccgattccggcattatgaaaaagggggcaaagggtttcacgtactgagaaagacaaaggccaccgtctaatcaccgcagcttggtaactttcacggatttcgacccgaaatgcattattgttgcaccgtctatgccgttttgtttcttattgttgacgaaaatttcattggtgaggggaggcccattatgaagtctctgaatcatagacaatgggggtgagctcgcagtgaatagagacctgaccgaaacagccctgtgactattgaagcgaagatcaagtcaatgtcagatgctagatcagcgtcttcgaatcgcccagcatgcagcatataattcagctgtcgcccttggatctgtcttcatccaacatcgcacaaccagaccttctagacacatctcactcaaagacttccgacgcaaatcccaaccagcctcaccaagaatccaatcgtcacttgccaattatgggtcttacgtgggatcaatctcctccatcggagacacacgcggaagaagctctccgcccaaagcctcaactcgagtattggccgttaccaaacgtcgaccactatccaggcgtggctcgagtcagcatcggggtcctccaccgaaatttcaacaagtcaatcaagttcgagggccatccagcagacattatctacggctctactgaaattatgggaatcaagaagaagaatcactgggttttcgacatccatgatcttcgattccgcgaggaagcctcgggtgccgtctggctcctgggtgccgagcttttcgttgatggtgtgagtgtccacacgcttgaatttcctggaatcgcggttgaaccaagtccaagtcgcctttctacccccgagatctttaatctagagctggacgaggcaccgacgcccgaagacaagaagaagcccacaggggccaacaacaactcccgacgcttcagcatcgatgattattgcacaggtatctaagggggaccacgctcgacaactcccatgcttgttgcaatgattgacaacgaatggcctcattttcccatggcctatgtttttttaaagtctcgtttttttgctgttcagaaaaaaaaaagttgtgcgaatactcagagccaagacaacacaataacaacgagtcttaggttcctgatacaatggttgtgcggaaagggttgtgaccaagatcggcccgggaattggccatttaatatactatggtgacacatgattatagtaggagctcgaagaatccaatccctatcgattttccgaacttggaagctgattttgatcctaatagtaaatcgtgatgagactacagccgatgatgacagtaaaaaaaaaaggtaagcccatcctgaaccgaatgtttctgggcattctggactggtttcccggcccctcttaacgcttacatgggtcggtcagtaagcataccatcgtgcaccgcaaatgcgcgtaacacgacgcaatgcaaatgtctggagctgctgcctgcctgagcaacctcctcgaccccgcattgccggcgatcaagaaaagttcttcacaaagccatcccgtcgtttgtgaatcatggcgaccccaaatcccgcccgactcccgcacatccacctgctgtccatgtacaggaggtttggggataccttcgaagccgcggcggcggagaatcccctgcccgacgccgtgaactacagcatccactactactcgttcgagaagctcccggcgtcggtcaagttcgacgccgtcgtctcccccgccaactcgtacgggaggctggacggggcctttgacgacgccatctcgtgcgcgttcgcacccggggacgactaccacgccctgaccagggcgacgcaggaggtgctctaccgacgatggcggggtttcgctccgccggggacttgcacggtcgtacgcatccctgacgagttccaccccaggtccaataaccagtgggataccaagtacgtggctctgtgccctaccatgagggtcccgatggacgtgcggtgggatcgagaggtcgtgtacgagtgcatctggagccttttatgtgcggtggacaatcacaaccgcgatgttcgtgaaggacgagctgccgagggagagacggagattacgagcctgctcatgacgccgctcgcaacaggctgtggactcgtcagctacgagagatgggcggcccagtcggtgctggcgctcaagcattatgtggaagcatgcgagaatccatcggaatggagctctctcgggtgggggacaatcctctctcgaggggcagaaattgataagacagtagattcggaaactatgtccagttagctttacactaacaggaagtctcaccaactctctgataggcagatccatcatcaagccatggatgttatccaagagtctatcgtgccaagagaaggtcactgtaatggcgatttccaggggttcaatggcggctacagtgggctcacagccttacaggctcaatttgaggtgaattgacctttggccgcccaaatgtgatccccagtcaccatacctagacggtagacttttttgcttgaaacaagcagcaatccaatataacctctgccaataccttttagagttaatttcatttaggttcacgatctgaacggccatgtccctaagaggcctcacaggctaccgtagactgccgctatttcctcgctgacgcaacggctaagcaatccgacggctaactaagattacctcctgcttatttcaacaagggttgcgtcgccatctacacacgtgcttcgatcaccactgttcgctgctacagaaggagtctcaagcaggcaagtggctcggatgttcggggacatgggaattagacggtattgccgccgcggtatcgatataccagagcaatattgtctccttctgggttccttctgacgtcgctcctggtgcccgtctaataatcaagtggtcttacgacacattactaggttgaggtcaggtcagtgctgcaacaagtagcagacgcggatgctacattgatgaacaaggttgatcataccccccacgtgccttctggcctacgtcaattgtaattaactcatgggctgcattgcgattgatggaggagagatcgaaaggtcttctagaagaacacgtgcttgaagtattgggaaaccattggtttgccctgcctaggatcacctcgccctgccgggatatagtggcggggcgctggggcgaacccgctgaaggccctgaagcttggcggttggtacccgcagagaagctctagttcaactctctaaatccccaccagcttcacttggatccggctccaccaacactacgactgtttaccagctgggagcctaccacccgtctcggatgcaccgtcgcagcagcccagacaagacttccccgatttagcgatcgatagattggcctgcggaaggatgatatgatggaggttgcatataccaagcatgggccatgctcaatcaggcagctccataagtagacaattgcgtctactcttcggctggctcgttatttaactgctcagctgccctcttctggacagctgtgtacgaatcaagcagtcgctgctcacacgttcttttgtttccagatccttctcgccacttcaagtccaaagatgatttccgccaccactcttatgcgcctgttggcagtcgctccagctgctgccctcgccgggctggtcgtccgaaatgacaccgatttcgactacagcgcagtctctctgcgagaggttggagctcgaaacacccttgtaagttgatgaatcgtagatccgttttgttcccaagctcccagggcaagctggaaagcaatggcgataggccaagagccatgtataccaagaagaacctccaattgattgaccaaacccgcatataggactggcgtgtttggctcgagaaggatggcaacccaatctccttctggcacgatattcctctttaccccaactccgaggacaagtccatcatcaacttctacaccgaaattcctcgatggactgatggcaagattgagaccaagcgtgatgagcctctgagtatggttgactcaagccttcttataagagagaacatccagctgactgaaaggaaagacccaatcttccacgacgataagaagaagcagcctcgattcgtctactctgtctggcctcacaagacataccccttcaactatggctccattccccaaacgtgggagagccctaaccacaagcacaacctgactggctatgttggtgacaatgaccccattgacattttcgagatcagcagcctcccgtaagcatctatctcctcttttcaaacgtcatgtgaggaagctaactaatggatacctttgcgacagacccgctgctgttggagaaattagacaggtcaaggttcttggtggactgcccatgattgatgtgagtaccatgcgggttgctcttccatgatggaatagttaataacgtgatgtacaggaggaaaccaccgactggaaggtcatcgccattgacgttaatgaccctcttgccaagcacgtgaacagtaagtgttttccctctttgcccgcaaggagtacgcaaaactgacctagcgtgtagctgtcaacgacctagacaagtaccgccctggcctgcgccagcaatttcacgagtggttcatcgtaagcttctctaccagtccctgatgtgaccaatgctaactgatcgccctcccgggtataaagtactacaaggttatcaagggcgatggaatcaacaccatcgtgggtggtgaatacaaggatgccgctaccatgcaggacgtcatcgctgagagccacggcttttggcaagatctcgtcaagggcaagggcgagcacgagaagaacgagatcgccatcaaccagacctccaacgcccgctactgcaagtcctatatcaagagcagtgaggctaccgaggctttcaacatccctgccacgtccaacatcctccccgccgctgcgcgaccatcggagtatgacaattggtactacctggactcggactacaaccaaattattgtttagaggaacctcctcatggggctaataagagttgaaacctgtcgatatcatatcggcacgctcataatgtgatatagaccttgattttctctataccaactttttatagtatatatctaaacgctggcattgacaagaataaattattcaatggtctctatctcatttgatcctgaattacctaggtatcggaaggttaaatgtaatccagccagcaccatagccgctccccactaaaatgaatgacattctcacttttgcgagttgactcattatgcatcaccaagccgcatggcaattaaagtgcattcaacacagaataagtcttgttggctgagtagctgccgcgacttatttgctgggctggaggagaagttgtggagagtggggctttagctctgattaaggttgaaattctgggtgaggctttgcggcaaagagtcataccgcccgtagcgccttcttgcaacacacaatcgtgcatctaccagatggacggggatagataaataccgaccaaatgcctggattcatctatatttattgtgccaggccgccgtgaaaaccgtacttggattacctcgcagaattacagactgcatcatctcgaattgagtttcatgctcggaagaccatcgcttcgagtcccacagatccagcactgatttcgccatgtccaaaccaaaggataaaaaggcttcatttgcaacgcctctgccccagtcgacccgctcagacgtgctcgagtggcggttccccaagccgttcaaccagtacgtcctcacaggccgctcccgcgcagcctggcacacctcgttcgtcatcccccagctcaacctcctgctcgacgccggtctggtcgtcaaccgccatcgccccaagcatgtcttcctcacacacggccacaacgaccacacgctgctgtcaccggcctttgtgaagcgggaagatcccccggacgtcttttgcccggtgggcatgaagagggtctttaatgacttcatcctctccaacacgatgctcaacctgggaggtcttatccagacggaagatgcggaggagtatggtatggaggtgaacgggcacacctcgaatgtgtgtgaacctgacgacagggagcggacgccgggcgaagctgcctacctgaatacgcaccacacccatggagtccggcacggggatgtcgtgccgctccggcgtctcaagggaatcaccgccacggtgtttgactgcgaccacagcgtcccctgcgttgggtatgtctttaacaacacgacgaaccgtctcaagcccgaatacgcatccgtcgagggaccagaactgaagaagctgagattatcgggagtggagattactgaaccgcacaccaccccgatgttcgcattcctgggcgacacgacggcagaaactctcgcctcggagccggagtggctgcgcaacggcatacctgtggtgataacggagtgcagcttcctcctcgaggagcacagggagcaggccatcaagacgaagcacacctactggcccgacctggagaaggttatccggaaatggcccaagacgatatttgtgttgacgcactttagcctgcgttacagtgagaagtctatcacggcctttttcgccgatctgcctgactgtccagggaacattgtggtctgggcggacgaggaagcttgagagattgtcttcactcgcaggtctcggcgtacaggtcaggagaaaagcgttgatcttgggttgggaatgaataatttggttgtggcgaattcatttgaataatttggttgtggcgaattcattttctggagcgataaaaggcactggcgtttctttatgatgaaatagcgggaaatagacgacttggggaaaacgtggcccatagatactagaatagaatcctccagaaacagagacttcaagatgagatcttgttgccttttcctcgaaatttggggtgcttagttgcccaatccttgttgtgtgatgactacctactgtgcctcaaaaaacaatcctcacgccatgggtttcaagcgacccctttatcaagagaaatcatgcacgtggaattctattatgtacagcctgtcttgaatatgcccaaaatcacaatcgaaccagcaaaacataacgctaatgctccatcccaaacgcaagccgaaaccatatgcctccaaagagtggccgggctgttaaacttcctaccgagaagctgacccagctatcgtccatctatataacgccatcctgaaatatgcgacccgacgctgccaatgaaggctagggggataatgccttattttcgaaagatcaacgccatgcgagaaatcaaacgatattcccaatcaacatctggactggaaatgtaatgggaaaaaccggagccgacgtagttgctccattttcaaaagactcaagctctgtatgatgcagacctggttctcttcccctgaccgcttccagccatgagcagcttctcctccaggaaaaaactactcttctcgtccgagaattgctcgtggaacagctccaggaggttgccgggaatctgcttttcgacgaagaacttcatcccccggtccttgccggtccacagatgcttgatgaacttgccctggcagttggtccggctctgggggaacccgttcgcctccgagcatgggagctccttgatgtcccccgcgtagtcgtagcggatgaagttgccgaagccgccctggtccgtcgggctgccggggatgttgacgcgccacctggtgcaccccgggtgctcccctccgtcgtcggggcagacatcccaggccttgaggatctcgtacgtcttcttgttgttctgggcgacgatgaagcccgtgttgaggtagagcttgccgaacttgtccctgttgtggctcaggtccgggtcggacgccatggccagcgagttagtcttggggtggatgtcccagtagttcatcagccactcgaacggcaggtcgaggcggtcgaagatggcgtccgagtcgaggtagatgcatgtctcgtgatttttgaggatttcgctaatcacggagggcttcttccacgatgctcgccgatctttgaatgaatcaacctgcacgtaatagtatttgtagccgtggatttttgctagggcacgtcagtatgggacgatcaagtcgaggatgaccacgacgaaggaaaaagagtgcagatcttaccataaagccagtggttcagaaacccgaccgagagcccgtggacctccttctgatgatcccagctcatcaatttggggccaaagatctggtacgggtcggtgaaggggcggttatcaaggtcaataatgcatagattgtttcccattgccttggaccatcttgggtctgtggaaagtttcgactcgaattccccgtttgcattataatcagggctgtctaccttcatgtgagagctcaaggttttctctatgaactcctgccgcagtgcatcgcgttcttcttttgtgccctttagcacactcttatccagcggcttttgtaggtgggtactattggcttgatcagttttaccatacaaacatacacactaatcacgatatagagaggaaaacagatgggctaaatgttgcttatggcctaaggcggagcaaggagttgtgctcaaggtcgaaaaagcatcaatcagaagatgatcgtagcgcaacgtaccttggggtaagccgtatggaatccgaataattggtatatgtgagaccgacgacggtagacaggaagacgatcaccgcaacgaggacgaaggtaggcctgttgggatgacgactctgggttccgagcttcatggcaccctaatccttggtaggggtattgtatgtccgctgagaggataggggccaagtgctgctcaggagatttcctatattattgaacaggagttgctagagctgttccgttgaaagatgtgaattccgagaatgagtgcaactacctatcaagatcaagcatgtcagacaagatggatcgatgaccgccggatgatctggagactgagtataggaatagagtagtcagtatggaaggagtggtagtgctggcagcctactgtagacacatgcatgtagatgatacaggaaagcagattctggaggccgccgcccaagattgatttcatcgccccagtcccacgcaagaaaccatcctcaagcacatgaaatccggcatcccggtcatgtagtggagtctttttgtgtctagcgggctgcattaacaccaaaatgcagccttcatgtgggcgagacaggggtaaagagtgggattggcgggccgttgcttcgtcatccatcttggctttgtttacttggagactattgatttcttcgtccctgtttgcgatcactgcaaagcgaatatctacaaattcctgccaaatctggccaatgtatagtcgcggaagttgtggttcaagtaggaattctatcggcactcgagactcgaacagtctcatcaactgaacctgaatgaaagactgctaaactaatgtccagttgacccctggcgctttaggaccaggatagtcacttttaaccctgccattcctccagcaaccgtcgccatggcctctgtagccgtgtctcatcatcgcttctccatatccttctctttgggattacgtacatagtaggaccatgttacgaaaagatatcaatcaactaattcttcatggtgaaggaactatattgtccaacttatcatgcgatatctccctggagcaggccaaaagtacatgattacttctatgcgccattggcggggtccaaaacaaagcgattaatggtgtcgcatcgcttcgtcagatctggcgcccaggtggcctcctcaaaccgatcagtgatattgaaaatgttcttctctgggccatacaacggccaagcaacatcatcaccgtgcacaaagtccagcaactttgtctggaattcgcgagcgagtcccactccctcttcacccagaggtgtttgctcttcatcaacatagaagaaatctaaatgtggtaaggtggtcaatcctgggctgaatggcagggagggatgaaacttacaccacaagtcctggccgtgggtggctggcggagtggacatgacatatcgcctcgacttccctggcaaggcattggcgaggttgtacgagttgcacgagaaaatggcatcagtcgtccagtcccaggcaagctgtgccggtgtctcgggatggtagtatagcgtttggatggtcgagaccacctcatcgctggcattcggcatgatttgacgcaccatggttgggaagtactctggctggtcggtatcatgcgacgtgcccatcccctcatacgccatgctgcccatgataatcccttctagctcttcgtgaaactcaccggcatggaactgcgcaagaggaagatcagggatggatttgccatctggtgcagggccgtatcctatgacaggacccaggacaccgccgcccccagtggatggcatttggttgacaagcttctcgctggcgtccaagatggcctgttctggaagtgaacgcacgcactttagagtggcacaatctgtcacgttgagcagaaggccaaactgttctcgctgacgatctgcgacccgtcgtcgagggggagctgctggcgaagatatgaacaactatcgcagttagccccctttctttaactcacctactccacggaagaagatctatacatactttctggaatggcaattctcctttgcccccatccaaagtagtcatgtagtaaagcatacctgcgccggcgctctggcccgcagccgtgatgcgcctcccatctcctccaaacttgtggatgaacttggaggtccatctcgcagctgcaaggcaatcaaataggccaacattggcctccatatcctccccttctgaataagagaacccagaaactcccatcctacatgtattggtaagcgcgtgccacacgggcggttcctcttatgatcgatcttacctgtagttgttggcaacgaaaataaaccttcctttgtgttgctcaaacatgtgctcgaacagccccatggggctgaagagaaactccttgctcccaaagctatacgcgctcccatagaagaaatggaggaccgggacgttgtcgcctggcttcacaccctgtggcacgtaaacgtccagaaagaggcagtcctcatgcccccacgtagtgccattgataccgggaaagggaatgtacgctggcgcagaggagatacagtcacggctaccgggcggctcatctcccttttgcacaccgtctacgtggggtagatccgtgttgggcctgcggaagcgcaagtcgcctgtgggcgcgttggcgaagcggatgtttttgtagatggtcacattgtggccggaggttgtggtgttggtgtaagttgggacatggcgggcatacccgagatcgacgagaccgttatgatcgcctcgaccgtctgggcatacgcgagctaccgagccaacaatgacaaggcctgcaacgagaacggtgatcagaatcatgttagaattttttgggagattttatgaatagaagaatgtttattgatgctctacgagggaccactgtctccaaggtcttttgactcatctatatagcctgaggaaaatgcccaaaaaggaaaacgaggtcaggcgaggtttggatgatgatcgtcagtaatacatctccccaatttacccttgactccatcctcgatcgttgtcatccttcatatcatcttccctgtcaagtaaacgagagccgtgggagggaaagccactcattctaggctaccatcaattgtgcttacatagatgagatatctgtgcccagctagagtcgtgtatagcttcaaggtggttgagctccatattttccgatgaagctaatgcatcttgctcctcacaatggtcccaaaaaggaaaacgagactgacgccacaagccaaggccgatcacccctactttaaggctgagccgtattggccgtaacgagcaagctcaatactctgcgtattcccttcatggactggttcgggacgtcatctctactcttcccttgaaactcgtgaggatcacttaggatcaggaaatacccagtctcagatcctgaaccagcaatggcccgtgacttcaccatcccagtctcgggtcttcaggtattaatgcaggatgccgatgagaagttggagacacgccagtacaagaagagaaagacacaccccaagtccagaggtggctgtggcagctgcaagttgaaaagagtcaaggtactttttatattgatcccagaacccacccgagactgcctctctggccacgacgggcctaaaacaggtgaactgcgatcagctaactgtgttctggggccggaatagtgcgatgagaccaagccagcatgtaaacgctgcctacgaactggtacaaaatgcatctacagagacacaaatggcacctcctacaaacccatggaaaaccagaaacaggatactagtcctctaccgttacatgctcgcggagaactgatacaacaaatagcactgccgactataagacaagatcttcaagcagaccagcctgcctcgccctttgggacgccaaggttcaccctcctccgccatttctaccacgtcttcgggcagctagacatgttcgacggagtggcaacagacccagtcgtctctctcgccctctctcgacctcacctgatgaacgccatgctcgccgtgtccgcgtcccatctccgctgccacgccaccactcccgtcccctcgcatcgcattgccgagcactatcagcagtccctcgccgtacgggggttccaggccgccctagaggagtcctgggaccctctcggcgcagacgccctgctcctgacatccatgctcctcaacctcctcaccttctccatcgtcgaggacgacgacccgtggaagtcgtgggtgttcagcgacgacccaaatcgtctgggctggcttggtctccacctaggcatgaagcctctgctgatctcaacggcgtcctaccggaaggagggcaccatgctgcagtggatgttcgacgcgtccgacgacgacaggcgaacattcaatgggacgccgcagccgctgaaccgcgtccctcgtgcgtggacagagctctgcgggatctctccgagccaggtacactgtgcagatcccgatcacatcttctatgagcctgtgaggatcctgggggagcttcaagacatggaaccgcggcacgagctcctgttcatctacgtttctttcgtcggcaagctggacagcgagtttcgccggctcctggaattgggggacccggcagcaatgtggcttttcggatactggctcggcctcgtggcccgcttcaacttctggtggtgcaacaaccgggttcggcgggatcaccaggccatttgtatctggtttgagcttcggggtttcgcgaagcgtgcgggacccgaaggtgagatgtggcgagaactgctctttgacttggagaatgcaccagtctggccttcgccgagaagatcgaaaagccgtatcggaatggtcgatgcgcctagtgagatcgacaatgtatgtgtagaagtataataatctgttctacattatagagctgcggatcatatatcgagctagatatacaaaagctaacaacatgatgtactgtcgtctcagccctgctgagcatggatgttacgacaccagggccgaccatgagccacctgatatgaacacaaagcaggctccagaacaatcccaataatgcctgcaacgcagataccaccgctatcactagcacttgcagcgctgagactgaactctctgtcttccgctgggacattttccaaaatctcagcaaaacaattcacatacactgcgccaccgagaaggccttcccaaaagatgattaaaaacacgatatagacggagggcagaaagaagtatagtgcatggagcaccaggaagagcaggtttcccacctgcaaaaatgatgggagataaaggtggtggatccgaatgaatggtgtagaggatctggatatgaagacaccaagttggtagaggaagccatagaacgggtagaatccgcgatactcgtggaaaggcgactcctctaccgggaatagaagagtgggcgcaacaccttggttaattgcgtactcggcgacatacacaaggaacagcggtaccatataggggacaaaaagggcaccagcacgtcgtaggttatgctgaaacgaatgtgtgtgcgacgaaggttgccttgcaaaggcagttgatgcgcctggaggttccggtatcaaaagagcagatgagacctcgggactagacatgtcttcgacctgttcgtcctccaggtccctgtcaggaatggcatcatattgcttcgcgtggccagcctcttgaagcggcccgcgaggcagaatcacgaagaagcttatgaacatcaccaccggaagacaggccgagaacagcaggctgtcccgaacattgaatccccaccaatctgtcagcgcaacatacagcgcagcacctaccaggccggcggcgcccgtccccgaaccccagccagcaaggctcatgtggccatagtagtgggtaagacccaagaagctcagctccccaccgccgctgctcaggcttgcgaacacgacaccgatcagcttgacggcaacagacttgctgggtggcgtcagtgccaccattagcatgcctacagccgacagagcaatgaagacaaggactcgtatgttgtaaggaactcggtggatgaagtatggggcgatgagcttcgtcaggaaggaaggcaggacatcggcgagaagcaccacacccttggggagggtgccaacgagatcttgcgccgcggacaggatgatgacatagaggacgttattaatcaaccctagcaattctattagcttcatgcgatgctggaaaggagaaggcagtggggggagagcctacccaaaagccaaaaggccacaacgactttcatgtcgggattcttgaacgcggctctgattcgagcagcatacagcgcccaggaggatgacggggtgccaggcatagggaggagcccagaagcagacggcgaggcgcttgtcatcgtagcatcgacaggtacatcggcattctagttaattgaagctggcagaaagcgcagcggccagcacgaatgataagcgcaacgggaggatggacgacgcaagataacaaagcctactcgtgacacggcggtgggctcttctgatagtggacagggcgaatttaggttcgcgtgacccgctaaatgatgtagccacgggccattccccggggagatccagctgacccatgcgctgtcaccacttcaagaacaccaccaagcttcagcaccacaccacccagatcaagaaccggtcaagacataaaacgttgtttttgctccctcgatgtgcaacaccataccggcatgtatatgcgatcggtcgtacagcatagtagcgattggctgacagagggatggcgatctcaatgccattgccccaacctgtacttgacagctcgcgtaccagatgcaaggagcagggaaaatacagcgacgtcttacgcgtctcagagaagaagttttggacatttgggcaagggatcaaaagtgggattatgtgagtatcaaattcaccacctctaatgtcgtgttcccattgagattaccagtgatagatccagccgaatgacggttgccaaattatagtatatatatgtcccctgattatttcattcaacccgttctggggaagcaatgcagttcggacaagaaatcatttcgaaacctgaatattgaaccagtattaccacttgcgcattgttgtggaaagtccagcgtcacggtcatgtacttcgttgatcaacctcgtgccgcccctcattcggctgggttgtggtaagtcttgttactatctagaacacagcattgtgacattgccgaacgtaggtcagatcagcaaacgatttatggcgatcgaagttttcattccgtttttacccttaattttcgtaaaaacacgatctactaattaatccccaaagcgttccgagcaatgaataattaatcttgcccaggctcgcacgcaatcgatcgcaatcggcagatcttcggaccgggagatcttttttttttaacatggagatagtctgcgtcaacaccaaccagagggagcagatttcagatctcatgtagtactagttcaaggacctattcattccgtgtaattcagaccattgaggtcgtgtatatttctaccataatcctttaatatcgtttccctcctttgaacgtgtacttcgaaccatcttcaaaatgtccgagaaatccgaatccgcatgccccgtcgaccacaaagcccgcgaggtctggctatcacaagcccgtgcagccgaagccgcaaagcccaagagcgcatcgccagctcaatgtcccgttgaccactccgcgcgcacccctcccaagacctggggacagaccttcagctcatacatcccctggggatcgtccgctcccgcacctacacctgccgccgtgcccggccaagcctccgggctcgagaccgatagggtcatctccagcatcccccgatcggctggcaatggcgccgcctgccctgtagaccacggcgcctccgcaaacgcagagatcgagtctggaacccacgagtccggcaattgggtctacccttccgagaagatgttcttcgaagccatgaagcgcaaaggctacgatgcgagaacggcggatatgaagacggtagtgccaatccacaacgccgtaaatgagcgagcgtggaaagaaatcctcgagtgggagaaaccatatgccgaggcctcgaagtgagcccctgcctcttcctcctccccatccgttgtaactggaccctaaccttcaactcttcccaggtgcggtggccccaagctcgaatcttttgcgaacaagatggaccgcatgaccccgacggcacgcatcaacactgtcctcggatacactgcgccgttcgaccgccacgactgggtcattgaccgctgcggcacccgcgtcgactacgtgatcgacttctactctggcagagctgatgggaagggcgggccgagcttctacctcgatgtccgacccaagctgaatacatgggaaggagtcaagatgcgggcaatgcgctggacgggtattgcctaaggccagccacccctcgcgcaaaatcaaatcgttaaaagaaagaaaaaccaccaattgtacaatagcgatgatccacacgataccaaggaatggcgttcacggaacagttgtaaaattagatcacacattatagagcagtacccttcttgttgtttgcgagccctctgataaatcaaccatcggcctatcatgactaggcactatctgtagtctagggacctgccgagtacgagcgttatgctatatcatcattaacacgtgtatctaatctgtacaaagtagacggatgccctattcgtccttgcgatgggcctgttggaagcggatccggacgggggccttagtctcgaaagactggctctcaagatcccatcccacgctctccatcttctccttgaactcggaatccagaaggtccatgagactgccatcgccatcctcgctgcttcccttcttcacaagctgctccacctctttcgtgaagcctttgccctcctccatcacctgcgcgatcttcatggcgctgaaccatgcattgaccgcataccatgggtcggagccatcccagagcatgatcttgatgctggcaagcccgttgtgctggttgccaatgaagagagagtacttgtgcccgtcgagaaccgacacggcgccgcagtttcgcttgtccatcgcatcctggaaatcctttgcgatgtcgatcttagcaacacgctcaccgcgcttgttgacgatgcgggtagactcgaagaggatgccctcccgcttcgcaaccgccttgggggagaggacggtgccggacttgaggtactcggagaagaagatgacagctcgctggcggttcaggttcgtcatatgaacactgcagacgccgacgtagttgacaaacaggtgggccatgaccagcacgaccatcaggaacatgacgctccggctatcctggaccagcttcaccaccagggtcccgacgagaaggccgaccaggcccaccgcagtctcctggctggcctccttcgcgttcagctcggcaaggttgtcgtgcttagcgaagtgaacactcagcgcggccttgctcgcccccgccgcgacaccgcacagagcacgcagagcctcgccgacacttagagtaagcaccttgccccacggtcccagggcggggctgtagagctccaagaagaaggccgtgtcgttgaagacgtccgcgaggaaacggtaccgcttcgcctcaggctcgatgcggagaccccagcgattcgcaaagacaatagtcgcgatccgagacatggcgtccgtgagaatggttaggagcagggcatacgtggccgaggagttggcatctcccaccccgaggccctggaggagggctcggttcgccagcagggacgtgatggttgagaagaaggcctggatcgagtcgcacgcctggtacgcgaggtagtcgtcagacaccgagtaggggaagcccacgggcaggaagcaatccaacagggtcttccgccatcccctgatcagctggacgatgaagtcattcgtcgtaccggcaggcgagatctggatctattcagctgggggcgttccgcagggatgcagggtagccttgcaaggcagaggaacttacgggaaccacgtagccatctttggtatgcagccaccgttgctggacatttccggatttatcacactctagtatttcaacggggcgaccgtctgcaaggagatcagagaggccgtctggagacgatttgatgaagtcgatttccttggtgatttgttcttcgcgtgtggacttgtcatccatggcgacgaattagcggcctagctagtggctgagtatttcgttataggtaggttcaaagtagtgagcctgaggctagaaaaagggaaagtaggtgaagagagcgtcgttggaatttaaaagagggttttgaagttcgtaggtgtacgagccaccattttatggttgggtggctggacaatgaaggacgagagattgtgttcgaggtgaagcggcagtgagatcgtttgtttggccaggcagccaaacatgggcgcagcggccaacggctcaaccaaccaattctgatcactcaaaatattgctccaaaagttgggacgttacgatacacaggtacttgatccgtttttgagtaacaattatttcatgttcatcatcataatttaattttgcctataagattatcagacctctatttcgctatcctttccaagatggtgtatcaagtctatcgcttagcaggctgaccatcctctgtgatgaggaactcgtcagtcttgacgggacctgatccaacaccggtctgtatcaccctgctcacgccatccttgaggatagcagcagtttgctcggggatcttggcgctcgacttcagggcggcagccccatccttccagccaccaacggcacccaggacctcgtggaacgcaccaacaacggtcgcagcatcttcctcaaggaagtaaatgacgctgtttggcccggcatcataagtgtaggcagcaacagtctttccagcctgggcattgatggcctcgaccgcacggatagctgcgcgggaagcatcgttcatgtagaaaatgggagggtaggtgtcggcgcagcacgcgtggaaggagttggaatctctcatggtaacctcagcaaacttggcgaaatccttgtcgcggacagcctcctccataagagtcatgttggcaggcaccacctgggttattctctgctggaagagcccagaggtggcgacggtctgttgcataccagaggtcgaggggacatccttcttggcagcattgacaacgaggataagagcccgcatctggggccagtgcgacgcctcagcaaccagctcggctttggagtcgaggccgtcatcctggctgcccatcctccaggccacatagccaccaaacaagcttcggcaggctgatccagaaccctgtcgtgcaatgagggaaaggtcggcgggagactctggcagctcgtacaagttggcgatggcccggacgagggcagcaaagccagcagcagaggaggcaagaccagctgcggtagggaagttgttctcggagacgatcttcaggggcagggtcgagagcttaggcagggcggagttggcagcctcgacagctgcgcggcgggctcgcaattcgcggaagcaagcctgggtgcgagcaccggaaatgtccgacaactcgccattgagggtgaggctgtcgccgtcgaaggtagcagagcaagctgcggtggtgagggtgcggagatcgtcctgggagagggtgacggagagggagctattggtgggcaggttaagcttcgcatcgcgttttccccagtacctgtagattggttatcagcgccgagcataagaaaaggacgcaattggggaatcgcacttgaccacggcgatgttcaccggcgcggtggtgctcgccctgtagaccttggtgtccgccattgcaacgtggggtatttttgatgagggcggtgggaatgtgggatacgagcttggtcaatggtcagaaattgcctgctttaagggcctgccgagagttcttgtcgctctgcaggatggggcacagaggtgagatggaaatattgagcaagctgcgtgttcgggtcgaagaattccggaagacggtgtggcctcctctccatagtgcgataatgcgtattggtcccctaatagagcatattttctgccattaatgaacggccctaaagcggtttagtgaggggaccggacgaagttgcagccccgcaaatgcccgttgatccttgttggcggggcaattcatcaacatgcccaatttcattcttgacgaccagatgtatatcattttaggcttgaagatgaaacagaattccattgtcttattaactatccaattcatggagttttctctctctctatttgctagatctagttttggaccactatctgcgtggaagaaagtttcgttgtaatgtcaatcacatgtgtagcctgacctcgaaacgcccttgcttatgatggccaaaaagaactacaaataagccggttcgattccagctgtgggtcgctcttagcggaagctaacagacagaagacagaaaacagactccaggacaatgctacactgccgatatcagaatcgatgtcacagagatagagtgtgactgaaagacctaatgagggcctttcaagaaggcgatgagggaagctgagaacaagatcaggaaacgtagttgcctgatccgcataggctcttgatgtcttcaggatagggcctctcttctttagttcatcggtattcctaccttaggaactggttttggtaaccatttgactaatattgcaaccaaaaagaagtagcctagtagagcctcaaataaatataaacccttgagacaggtggcttgaatcttgactttggcctaggatcgcctgtggaatatgtagggtaggctggcttgtcgcggttggaggcctgacgctctaattcggccactgacgtcatgactcttggagtcgtgcctggttatctcgtggcgctgcaagacatctaacttactcattaatttggagaaaaagagtagaattgggttcaaatattgaggtgactgtaaactcaatccttgacccaagctctagaaagtaatggtaatgcacttggcgatagccctacggcctggggctgcccgctgcgtcccaaacgtcctgcgcgcatggccaagaagagctccctcttcaatacaagccctgttaccgacaagaactttgcgggctcatctttcaactactacccaacgccacgaagctcggcagaatcacacccaaatagcatccgccgagagagacgacgcacagagaaaggtagacgaccggccatggcaaagagtgagcaacttgacgcgggaggaggccaagaccgccaaatctcagcctaacgatgactaccaaggtaatatgtgaaacctatagcttggagtagcttgctgccagttgcgcgtgctaacaggagtttgttgctggcaggaaccgtattgacgacgccgacccggctgctcaagctgatcataccgatgccgttccacccaaaacagaaagccatcgatcccgagaacgagctgaacgaagaccaaactacgggcaccaagaaagtcgagccgcttgcccttcttgtgcacccacagcagcctctctcctacgtggaaagactgattcaagccgaaatcccccccctcatcgctgacgggcgagagaagcttcctgggatagtatttcgagccgaggcggaacaggataaggaacaggagaaagcaccacgaaatggagacaatgtcgctacttactctggccttggccacgaaggccctaataacaagggtcacgtcaactgggtgcggtggagtggaagcactgaggtgggcgactttattcgagacgccgcccgtggccgcgagttcgagatcgagattgaagggtgtccccaggagctcaggatccgcgtgcctagcttcaatgatcgaacatactatatgcggatgaatctgagaaggatgtcacgccgggtcgaccgtatggctcagatcaagaacgagtgtgatcagatagcacacagaagtgctcatcgaatcgcccagggaggatttgcagccttggcagcctggtggggagtggtctactacgtgacctttcacactgagatgggctgggacctggttgagcccattacctacctggcgggcttgaccaccatcatgggtggatatctctggtttctttacataagccgagaccttagctacaaagctgccatgaatatcacggtgtccaggaggcagcatgctctgtatcaagaaagaggatttgatcagcagacctgggaccaactgatacaggaggtcaatctgcttcgcagggaagtcaggatcgttgcgagtgagtatggagcggagtgggacgagaccaaagacctgggtggcgaggaggtgaaggaggtcttggagcaagagaagaacaagaataagaggaggaacgacgacgatgaggacgatgagggcggacgtaacgacaaaggtgatcatacctcggagcaggaaaagtcgcccgaaacgaagaaggccgggaattgaagatatttgaaatcgagtggtcagcagaggttctagatacggggtcctcccgcccgcccgaccaatccccatgtagacatatgagatagtacttagttagcctcaaagcaaatagaaagatccatatagtgaagggcgattcgctcaaaagagcgcacatgcgatgaaaatttgcaacgggacccagacggatgacacttccatccgtcaacggggtccacgagttttggtgatctttctgggctcgttggccttgtccaacagtgaattcgccattggagaaagaatgtcactacgccttgattggggggaggcttgagtagatggacgggaggctgttggttgagctagaccaagatcatccgcaaggccatcggaaaagaacagtgctattccacacactctgactgtgcaatgcaggacatccatgcgggctcgcacagtgccaatcttaatttccccgcacctcccattccggcccaaaaccaggaatcatgtggagggccgggagggacagatgaggggcatttgcactgtatcatgctattctgagcgcatcactactaactcaaagctcctagttcactggaggtgcataactgtacgtacacgactgactcttctggagcagacgacattcctatcccattaaattgatgtcctgctccctctcctcctctcctcctctctctcaccctgtctgttgcttcacatcttcttcgcccgtccttctagctcccactagctcaagccgagacgccggcctgggttgatccttgctccaacgatacatgacagatgagacagctctgcagtgtagcttaattggagccccgcaatgccacagcaactacttcatttgccagacggccagaccttcacggtcacgcctgtctttggtggtgttggattcagaagccatgagatgaatgctgcgcattaccatgcctttcccatcggctggactatcgttcttcaaaccgaggctgaggccgagagtgataatgacgacccgatggataaggatgaccagaatggccttgatgagcgggacggcatgttgggtgcactgctcagtacgaagcgcacaatccactcttataccactccgaccttggacagggacaggctcttcatctcgtcaattgccaacccctccagcaatgaatttaagccagctgccagccctactcgccagattgccatgatgctctgggtcactctatactggtatttccaccagccagagccttcccacgtccttgagacggatgcctctagactcacccctccctgtggtaaacccaggggggattggaagatcaacatcacaagggagggagtgctccggggccggaatcttatcccaaagctggagaggatgggcttgattgccacttctaattcttcagttggtacaagtctggatgacaatggggagagctgggctcgcatgtttgtatcgaggcggatgttctggcaaatccctgggcggctgttccttttcaccctccagcccaacaggggcatgtcttctttcccaggctccccaacgagcagccggcctagctctcctactccgaccgattcgtcgcgccctcaccaccgccatacacactcgcagccgccaaatgcattccacagccgcggcgatagcgaccttccaggatcaccaacaccggtggctctcgtaggcaatcctggtgccatgtcagggcccttcgcctcatcttcccatcttcctacatactatcctcctccaccaccgctgtacatctcgacaaatggtgtccgccatcctctccggcccaagccaccacgaatgggtgaggtgttctactctaggtatctccctagtgttgggcaatatctgtcattccgggtagcatccaactcccccaagccggttccatatttggggccggttggccaaaaagccgccgagaaccaacatcttaccacgctgagcgatacctccctactgcagatgtggatgtctagcccacgtgtaagtgcgttctgggggcaatatcatcagaacttcctcaccgatgcctttcagtcgcgccactccttccctgtaattggtatgtgggacggagtcccatttggttactttgagatctactgggtgaaggaagacattctcggtcggcagctcggcagcgaatctcaagactgggacagaggacttcatgtgttggttggagaagagtgggctcgaggtcgtgtgcccacatggctcagcggattggtgcactggtgccttacagctgactaccgcacgatgaatatttgcttggaacctagagtggacaacgaaaggtgagtacccatgagagtatgagaagtagggagaatttgctaacgactacgatagattcatagagcggctgcagcaaaatgggttctcacggcagagacaggtctcatttccacacaagcagtcatggtatgtgaagctatcaagagactcatgggaaggtcctgttttatagtcttattgtgaacactatcctttttttttcttgcgtaaataaatgagagcgaaatatgggatacggcagataggaatcaagcatgatttttcacggatgacattcacttggtttacaaaaacttcgacctctgtataggtacttgaagcggatttctaccccacgaagtgtggctaaaactaaggggggatcaaaaggtacgcaaagtcattgaaactcctctcaccatcccattcccattctgttttctaatagcatagtaatgacacccagtgtttgattggctttctttaagtacgggtctattgcggacaagtgagcgatttctcgtctgtgcttggagaggcccaatgacgatgaccctgatgaccgaaaacatggatctcgatttctattgcgattaagctcaattggataattttggataatgcaccaaacaaagattttactttcctgctgaaatcagtgaagggctatctcacgataatgatgcaaccggtcgagcacgaggaaacatgcgcttccatgtcgcaacggagagtcccttctcacctctaagcgcccatttacccaccactctccatcctttgaccagtagaaatcatgcagcggctattaacaaatggaaaaatgccttgcgtgggtgtggcgatgacgcttttctgcaggtgtggctgagccgctgcaacctcgccccgcaaatcagcctcactctacaccagcaactcattgatatctctagaatctgtatgatgtagttcttgtcaatgtcaagaatttacgaaacgactcatctcacgcggataacatgtgaggatggatgtcgccttacgaaatgcggcgccgttgaggcccgagatcgcgctcgcaaaggccatctcggaattcgagagcagcctcaccaaggagcacaagtccaactttcgcagcttccgaacccaagcgctgagcgcatcgccttcggccgaagatgtgatgagattcacggccagtctcaacagccagatacagaaatcttccgcggcccatcgctgttttggcacacgcttcaccaatatcatgcaatgcgtccagaagtacgctgctctgggtgatgtggtcgttggagggtctcagaacatcattgcatgtggagtttgggccttggtgaaattgacgatccaggtacgaaacaaagatcctttacttaatttgtgagatgtcattgaccccttgtaggtatgcattggctttggctcgtacttggacaaggtctcacacttcttcatgaccgtcggccaatcagcaccgcgatatgaatctatggctttactctaccgtcggtcaaagctgctgagccattctatgtcgagttatttcctggtgatcgtgcaaacctgccatgagttcatgctcttcagccggaaatccttccttggtcagctaacagcctctctggacgactctaaactacgcgatgcccagtccaggtcggaaagactgggtgctaaaatcagagaggaggtttcatttctcacaacccagacggttgagagcgaggctagcgagaacaatttgttccgcgcgctggttgggggtgcctactcctgggagacacaacagaggaagcttcggcaacgagctaagctcttggaggccctttcatcctctgatcacgagacgccctttaggcaagcacggaaatgtggtgtttcaaccgtattcgaggacgagtccgcatatctgtcgtgggagcagtcgacagaatcaacaagcttggtacttgttggtaagctgggttcaggtaaatcggtgaccatggccagcatcatcgataatttgtacctatcgagccatgatcgtgcggtttctttcttcttttgcaggcacgacaatgcggaagcactcactgccagggctgtcatcgggtcactgggccgccagctgatcgacaaatatttcaaagactccctgctggataatgtcgtggacggcgtgaccaccatgtttagcttgggggatgtcctgagactcgtcaaagatactgtgccacgcgacgcacgaattcactttgtcctcgatggggtggatgagtgtcaagaatacgacgccattgagatcataaaagcacttggagaaatacagaaattcatgtatctgtccgtctgtgtatcgatcagaagcggcacgcaagaccaccaatccctttttagaccattgttgaacatccaaaccatgaccatgcctgaaaagaaccctgatattggcaagttcatcgaaaaggagctagaaagaaggatagaagccaagagactcgttcttggccaagaaggcctggtagttgaaattcgagatgctctggtaaaaggggcaaatggaatgtcagaataccccccgtttatacccatgaaaggagtggataaggaattcggactgacatgtgggtgtggtttaggttcctatgggttgcgctacaaatcgactcgctctgtgacgagaaatccgatgcagccatacgcagcgccctgcaagacttgccacctgacctcttcagcacgtttgataggatcttaaagaggtccaggaaacttgcccacacgtaccaaacccggatcctcaagactattgtcgccgcccatcgcccgttaacagttgacgagattcgagaggtcattagcgtggagccaggtaatactgactggagcccggacatgctggtaaatgacattcacggcgttctggcctgctgtggaagtttagtgactgttgacgaggagaatctgtcggtttatctgatccaccagagcgtgacgcaatttctccttgagagaccaaccgccaccagtggtagttcgaatccagagtcgcacttcaccatggaagaagcccagaaactgctaggtgagagtgtgattacgtatctgaactgctccctttttgaaaggcagatttcaaaagacgtcgctcacgaggttcgagttggagagcttccttctcgcgtcatgcaagaggctttggcgcctgctggggtggttggccagttggcaatccggtggctgaagtcggcgtccaaccccgagtttgacgcaaagaaggcactgacggaagtaagaggacggcaaaggagtcgccaggcaacagaattgttccacttcctctcatatgcctccaagtactggcttcaacactcctcgtggataagtaaagagtcgaaactatttgaattatgggttaggcttctggagaaccccagattcgatgagttaacatggactcaggacttcgcatctcgggataatttgatcctggacactgatactggcgttctttggagcttttcgcagcgcataatgtgggcaatcattaacgcgcacatccccttatttcgctacgaaatgaaagggagagattggtcgaaagcttttggaacagtgattccatacctgaggagatgcatgcagtgcaaccctcgaccgaggatagctgctaagatgtgcacgcagcttctcccactcgtcgccttgttcaaggatcatgcagttgtcggctggctcgtttctatgggagcctcccttccgttcgactcgaataccgcattttataatgacatcagcgactcgaactatgcaatagtaaaggcaaagctgtctcatgatagatcattcttttcaaaatctcaagtgggacagcttttggatctcgctcttttgaagggagattcgaacatggttaagcttctatgccatctcccagggctccctttaagcaatgtgctcagtggcgacacatcggatccattggtcatcatgattatttatcacttgctcaaaggggtaccgcggctctaccattgcaacgttgatcggctctgggtagatatcaagttgattcaccacaagaccaacaatagcttctttgacatgacaaaagctatcttggaagctgcaaatagatctatgccgagattgaatttcaacgcactgattgaaaatgggatggaacggtactgtctcttatctgacctctcacttgtccaggctcttcgcccttggttgagggacgacgcaaaagttgaggtcatttcttcctttatccgacatgccctccacgatagatcaattgagcgaagcaaaatcgtatcaataatctggaggtatatcgatagtgcttggaacaaggattccgaacattataaccaatacgtcgagcttgctcgggaagctctcatacgttgcctgcagcttagggactgggacctcgcccgtgacattctcttacggaacgcctctcaatcttcggtactttcgataagagccataaagatcagcttaaggcattacatcatagaaagtaacctgttgcattattgtgcagatgcagcagactgggacggcctcacatttctgaccaaggatgtcgagtttccgctcaacaacagcatcgcccgcttctcctctcagtacgattatcaaacgccactggagatcgcgctcggggatgacttcgagaatattctatcttttggtaatgcggtccgaacgattcaaatacttcttgggagccgatcctacggaaagatgaagagacaatcctatgaaaccgaagccttcgaagcattcgaagactttgaaggctttgaagcttttgagtccttcttagcgtttcttaacaggctccgcgacttaccagacttctcccccggaatgactgggcaggctaagcagatcatagatgctattttaaacgttcccagagattctgacaaagactacacggtgcagctgcttttgtggtgtattcttcagagctactcgggggcctttactaaaagcgatattaaagggcgaactatagatatagatgctttcttccctaaggtaggggtatgccaagtccactacaacctacttattgacgcaacactgtcgtttcgcaccacggaaaaggcgaagattatggtaccatcgcaactagttgataggatcggtctgatagacagatggcttcccggaaaactgcataaccaaggctgtgagagatttgaggcccaggccgacgctgttcctggatggttgcttctgaatatacctgaagaggacattgaagatgttgctccaaaatgagtaacgagaacctgagacttggaaatcatgcctctcaaagccccgaatggaattatgtctcgagaccgcaataatttaaatttgcataaggcacatataccgaaaccggcgacatcaagtgtatcgcaatacgactcttacaccaatggaattatcatgtgcttcagcaaacccagatgaagatctagtagtgatttatatttactctcctatattcaaaaaccctcgatacgcatagctctcctcataattctaacacgccttgcataacatggagacacgttcggctttgccctcaacacactttactatgaactcctccttgccagactctccgccgcattggaaacataaaatcaggttctcgtctcctaccgctagatgcatttgtatggaagtgtccagcccaacatccttttgaagctcccacttacgacggagcacgcacttacaatagccgcgcgaatccacaaatatggtgcgctcggtctgccgagggagcgagccgggatagacttagacacctaggcatgctttacccgtctgtacagtgtttatggcatgtatgtgattgatgcagtcctctgtggtgacgtgaacgaacacacataatatttggcagtctgctcttctgggttcaaagagctgattctcggacatcgggaaacgcatttaccatcccatacagcctgaaatttaagccttgaccaaatcgttcagttagtgacaagaagttgtttacttcgatggttgcatttatatggtatttgcgcttcgccggtgcattggtcgtacccatggttaagatggcatgaataagaggcaaatagagtgatatgctccaacctttaccaataataacagctatacgagtgattatttcatttaatcacactgcatgtatcctcatcgctcaaatgcaacgacacaagatgatattgcgatgctaacgtagtttggcatggagtactagtagatggaatatatgatcgtgacggtaaagaacgattgagtgcaacatggccaagcccggttgatggtcaaacagggcaaagggtcactttctattcccaagtgacgatctcacaagactgacgtttttatatccttccaacacctctaatggcatacctccaacattcaatcgtgatcaccaaataacttttaaaagctaggccggtttgattcaaagctgccccctatattcaatcccaagatcaacgctgttggacgcagtagcctcggccataaggctacggaaagaccatgcgtcggatggtgtagcctatcttcgaatcgccgccgaaaactcatcactctcgtgtaacccagcggcatccgaataacccatgcattcacttgtaaaacagtaacacgtggtcgtccatcttcgtatccgtatggactcaccaactatcatcgtcaagattgtcatcctgcaatcgagcgcagaggcactcaatcacatcccacgcccatgtttgccatgctcgggacttctatataactacaaaccggaagggcgctgcggaaagcatctcgctccgtcggggacatccctcagccctcgatgccacacatatcacctcgaaaaaaatgagtcccagcaacacccacccctcgtcctcccacccgggggcgaacgccagagagcttctacgcacaaacacccccgtcgccgccaccaccaatccgccacaaaagatcttcgacgcgaggagcctcgcggggagccgatacgattcatgcgactcagacgactcatgcggcagcgacggtaagacaccaacgctgttcaacacaccaccgcggcctcctctaacatcgctgggggcgacggaccaacctccccggtgccccagccggccgaggggcatggtcctaagggactgggccatgacaaagatcccggacaaggaaatcctggatgtcctcaccaagaatgtcaaaatcggggcgagggcaatctccattttcgaggctgctcagcctcgccttggcagctccgccgctcagcagccgccctatgatctcgcggtggcactccacaactctctcagtgaatcaagcctctccattgagcagaagagaaatctcttcatcagtctggattggaagtttgagtgtcttgcatgcggagaggccaagaagcccgacgctttcgacaaagggtttcatctttggggccctgcaaaagacgggccaaaaccctggctgaggagcggaccatgtcggaactgcgtcaataatatgagaaaatccaagaagccagaagcgctcgtcaattttgatgtctgtcttcctccggaatgtgctaaaagggggcgatcggctgagcagaagagttagacacttgttactgatcttgtgtagatgtagacacagtcttagaaacaatgcgcaagcagctagataataatataattaattcaataaattactagactcacatagatacgtttaaaatctctatgactaattatacgcatgtgttttaaacaattccctccaatcatgaaacgtttatcgtagatgttaccaaaagtagagcatgatcaatgtctctccaatggacattgatgtccaggcctaaaaagaattgacatatagtcttaagtagactcctgagactcttcccatagttttttggccagctccttcttgatatataagctgaggcgtgaggcagcaccgcagtaagccatgtcatcgccagggcacaggaatgagcattccgagtctgtcacattctttccaggcgtggcatccgtctctccttccaagttcaatttgtcaccacaccagcactccctgccatattcaacaccagcccaatcatactcccaacaacgctcgagacaggacttgattgtcatattgtcaccattgttgtagatctgatcatccataagtcttcccgccgatggttcttcgacacaagagtaatatgtgaagttttggtttccagggtacacgattggacccgtcggggtcgatgaggctgaggtaggagtagttgtggagctagtggaagagatttttgagggtgtggttgaaaccgactcagattcggaacttgacccagcggtcgagctcgaagaggggccgggagtggaagtcgagctaggaatagagctggaggatgagccggaggaagaaccgggggtcgagcttgaggcagagctggggctggaatcgacatcatcaaccttggagctggatgcagaggccggagttgttgatgagactcccgaggttggggtagccactggggtagacgaggcgccagaatcagcagaaacgtcatgcttatacaactgtaagcgcatggaaccaccgcagtatgtactttcatcgccagcgcaggtaagagagcaggtgccagggtcatctgccttggtgctgccctcacgaagcgagtcatcacaataacactctcttccatactcgacaccgaagtatgccattccagagcagaaattggcacacttctctagtgtcatgtcatcggtggcctcggtacgagctgacagaacgcgcccgtctgctagctcatcccaacaagcctcgaacacccattcacccactcttgatttgattgtaggctgagcaggttctgttgctgttgctgtcgtggttgttattgcagagctggaaacggtcgagacactggtgggcgtagcagtagttgtgctattgtcggggtttgtgccattgaatgaggctccatacttgtacacatttaaacgagagccaccgccgcaatattcggtagagtttcctttaggaattcttagaaaaatccgaagacgttaaagaagggttacacttacctgaacatgtcataccacaatcagcatcaggagctgagagtgatgcgctgctcagtgcatcaccacaccaacactataacccattggttagtacactgcaggattaacatttctaacacttggaaattgtcaacatacctctgccccatattccaacccagcgtagaggtattctcgatcagcgcatagcgcaacacacttagcaacggtagcttctgtaatactcatctgttgagataaagcgcgaccgcccgatgcaggctctgtccagcagcccagactgccgtagccgagcaccccagggttgacataggggccgccgggggggagaggttcagttgagttctcgtcccaacgtaacgaatcggcaaacagcgaaataaatataccagccccatccacaccgtctccaccgcagatctggttcaggtctccagagcagtcaaagttgcaatttttgtcatccaccttcaagttgggcactgtgttgccagcccagcattcgcgatgatactgggttccacagaagatgtagtctccattctcgcaagcgttgatacacatgaaaccctcattcgtgtcactgccatagagctgagtagagagctgccgtcctggattattctctttgtaacagccgacatatctaaacttgccttggccattgtccaggagaggtggagcctgttgagccacggcatcacaatcgaaatgcatggtctgcttcgaaaagtcagggtcgttgatgttcattgtccatggcgcagtgccattatacgagtcaacattgatttgcgacttgggcacagcacaggtgagaacagcagtagcactctctccaggtgcaagggtggtaccctcagcaagatcaacttggttgttggcctggacaatgctgtcgataccgaagggcggctttgaaactgtgagactcatttggacaccaccctgaggagcaccattggtgacacggagcttcaatgaaagagcagtgttttggtagacctgaccgaaagtgaagtgtgtgttggcatcatacttgacccaacctgtgccatcaggagtctggaattcaacgacagcaacaggggcagggccagccgaggcttcgatattgaaggagtcctcaccaccatcagtaatgaacttgacatagccatggaaagttccatcagtcgacgaatcaaagagaacagtgacggtcttgctgctgtccgcagcaatagtggtagggatatcttgaatcgtgaatttcccaaacacaatgctgccctgtccattccaagtctggagggttccgtttgagctttcgccgtattgcacagatgtgacagtgagcagagaccggccctcattgctaacgagtacagtctccgtgacaccattagggtcgtttccggtaatgacgccattaaatgtgaccgtttcagggctgatagacagtagaggacctgcactcccgccagtgcccgagacacggataagggtgttcttgctgtagccatcctgtgaattggttgtatcgacggcaatgttatcggacaggacgccaactctagaaggggcgaacttcgccttggccgtgaacttgctgtttgcggcaacctgcaatggaacggtaggcacgttagtgagcttgaagtgggcgccatcttgtagagcgatgttcgagactgtaacgtcaataagagcagtacaggtaacgtccctctcagaactctctgaggagatgtcaataggtccaaagtcgagattggcagtgcattcaagcggtgaagtcgttggggatccgaacccgtagaaagttcctagagtggtgcccatataaagtctaccatcaccaaacactgcacgtgtgaacttggtgcttcctgtgacatcgaaagacttgatcagattgagtttgccatccactggtaccgcgtcatatatgcgtagattgccctcctgaacatcacagttccaaaggaggccagttccctcctttccgtccagtgttgtgactgtgccatggctcactcctagagtgtaagcattgacattgggcgaatccgcaaccttggtaaaggaaggaacgccatcactgcaggagaacttgaaaacatgggtggggtattggataactgtagattttcaaaaagtcagctagatcgtcattctgagttacgcagtggcaaacacaggcgacttaccattcacataaatgtaacccccttccaacggataaacaccagcgccagcatacacggagttctcgttctggtacatttggattacatcatccaaagtcgctcctttgccgtttctgtatcctccaaggtcatccatattgagccagtatgtcttaccactctttccagtaataacacccatgcgtcttacatcgccgcaggagaactctgaaggaaggagttggagagggcttgttccgagatctttgtctgcaccatcgagggcctgcttctcccaaggcatgaagaagttgacaatggacaatgttccgtccgcgttttgagtcatacgaacggcagcctcctccatagcggtgggcggatcgaagccattcacggggatagtggcaagctgagaggcatagccatttccagtgccaaaccagatggatcctgcgtcatcagaggccaaaccacctccagacatccaaataccggcacctcgggtcgtttcagggacatcagggccctgggttacccatttctcaacaatgttaccagatttgtcccagccaatgacccagcctgagaaatcgtactgaacacagtgagatccgaatccggcatagaaaaagcctccagtatgtagaaggccaggtcgctgaagcagaatgccgccgttaaattttcgcacctggctattgcgagacacgatgccttcgaggttgatcgggaaatttggcctgtcgctcagatcattgacgtcaatagcaaagataaaatgacgaccagccgggcgaccctgaggttcttgactctcttggttctcgtacgtcttgacgattacatagtaggttccgtcatcggggtcaataacaccagtaccaattgcaccgaccgtagggttgatgtcaacgcagccatcaagatccgcagtcaagaatggaatttttaggttacgcgaagcgataatggcgcccgtcttggaatcaagcttatagacgttgttttgggtagtggtcacgtatacgtattgagtgtcaccccccgaaggcgtatagacaagaggttgagagtaaatgacctctttgtagcctttatagtttccaggaaggtcggttttaaacaattgaccccattcagagctgcgaacgacagctgggtccatgttatgatttctagctcagagcacccgcaatgtcagacctcgggctttttcgtgccaattggtggtttccaattgagaccacgaaggtgaagattaagtaaactcacgtttggtacccagcacgagtattgtcacctccccaggtaatggtatcggttgaggccaggccgttggccaggccgaccaacaccgacgcgagcaaggccgcgaaacccatggtttccgacaagagggcaaaggtttagaacgagcgacgtgccacgctcaattgggagcacatgggaatggagaaagggaacgatccccaaagcacggtgtgggaaacgcctccatcttatctgtggcttataccttcggtgcacagctagccgagcggagaagagttagattgggctcagctgcgcaagtgagcgttgttgagtgcagagtagtatcgagggaaatgccaagttaccaggatgtgaagaaatacccaggtcccagccagcaatacccctgtttgctgctattccgtccctgcatgtaagcggacaagaacagccatggattcaacgtccacacgtttttggaagattgcgtggagttggacaaggagctctatccccggcatctgttgaagatttgatcataacgaacgccatctcactaggcctgccgaattggcgtgggcaaggcaacacaggagtgagaactgacagaatgttgaaagaaaatggcttcatattgatatcacctaggtaataagacttgccataatttccacaattgacggctggtatgcgtctgtatgcagtaaaaaggtgagcagaagaatttcctcgagatacgagacgcatgccaagatgctagagcttgtgatggatggatcccgccaccacgattccagaaggcggcaaacaggggagggatggagggctcatggatcgttatcatttagccgccccaccgtttcctcagtccacttctgcgcggtactcagaatccgggctgttctcattcgaaaagttcgttgggaacggggaggtgcgtgtggttcgcgcgacgatcccagggcggccgttgtaagaagcagcctggtgtgcgttgctttgtcgtatccagccgcgggatggagtcgacaaggggcagtatgcaaccaccacgcacccgcgggtggcaccttattcacggtgtaaaaggcccggcgcggccggtaaagggaacgcgatggaaagatgcaatcttggcgttgagtaggtaggctagcacttaggcaacgagcaatggaggcgggcgaggttgatgaagggatcttggtctaggcaaaatgaggcagatgcgaatggcagacggagatgtctaaaaaggtacatgcaccgcctagaccggggcctgtcaccgtccaaaatgcctttgcattcgtgcctgccgccatttctattccaggcgcactggccgagtgttcaggcgccatcgatcgctccttctcgtccaggtcaagcccaaagctgggctgaggcaagtgcagccaacagccacaagcgaagttgctgaacaatagggtgcctaattagtaggtagaggcacctagaaagtttgaactgctgggcctatctgtccgcccggccttggctcacatactcttgggctgcctcagcttatcctcctcctggccaaccacgacagccctcgtattggcatgcagctctgcatatgtacaatctatctatgcaggtatacgttacaatcaacaccgctttgaaaggatcttttccagctcaactctcccaatgaattcctgagcccacagtatggggtgacttgaacgcggctgccatgcacacgcgcttgagcctcgctgcactcctgcatggccatgggccttgggttctctcacgacttaccatgcaggcaagcaattggttgatacctgagatgagtatcaaacaaaaaaagacgctgcgctggtccgtctttgcccgtcgcattggcatcagctcaacaatcaaaaatttctgctccaatggaaaaccctggcgcatccatgctgcagctggctgattgagcccagacctgctgaactccagctgataattgatggccagccttaccctcctccttacgtagcatgcggattgtcccccgtcttaccgggcggcaatggagggattgcccggggcccatagactcgtggagccatcttcgtccacattcacaagccaggtttttcaattggccattttcaggcagcttcaacttcaatcgccggacacgtttgcttgtagggtaagaaggcggctgatgagtgccctagctggaagcagaagacatgtagaagcatcaattgcagcgatctggcttttcagagttacaaagacaaccttcgatgaataccccttactatcttccccggccgttcaaatcgagatgccagggcgaacagcatgctgaacagcccaacaatggctgtggagcactcccgggccattccgactacagtctccctgagcccatatcttcttatatcccggttactttgccccgcacccgcagcgttagacatacgattgtcgcaatccatcagccgaatattgtcttggggcgctccaaaggctttccatctagacttatatcgaccttctcgttgtagaagcacaccatcccagcaacagccgcactctcgtgtgtcggtagtcgataataccagacaaggttctgctgctcatttccattgataacaatgtggtagtattctgcctcacctttgtaggggcacttggtgaccagctggctcttgcgaaggacggtttggtccacagctgagagagggagatagtatctcgtgggcagcccagtttcgaacaggtgcattgcaaaattggacttggcaacggtctgccctgacaccttgacctcaattggtcgctgagacggcaaaatgtcgatgcgcttgaacgggtccttggcgtggacatagataggctgatcttcttcaaaccatttatctgcgtggcaatcattttgggtcagttttgcgatgaaatctcagcagccgtctatcacctacccatactgccaaactcaagacggaccatttgagtcgcagagtctaagcttccgatcccttcaaagcaaaccacacgatctgttgtagcggtatcggcttcaccctcccctgctgcaactgtgagtgtggctaccgaagcctttgtgtgtccatcaatctggattttctgcgtttccttgaggtcgccctgcagatccttcaacggaacgtagtattgcggaaagtaatcatgttcccaaaccaaggttgcagctgtcgtatcaacaattatcttgcgattaaaaacaacccggactctccgtgacgtcccaagtaccttgcgagtgccgttcttgaccaggtgctcggccaattctgcgagactagaatgcattagcaacgcttgctctgcggcttgtgtggaaggcctactcggttccagaagcgcccactttcgccattttatatgtaatttaatcaatagacagaatatttgggcatggtcagtgatgaagagagttgatcttgttttatttccacctcggaagctccggtgctcagattgataataatattaccccgcatgaacgcagatgacataacggatacaacattttaagtaggccatctctagaaacctaaaccttttggatcgtttgatttctaatattcactttaaagcacattgtcggtgaccgaggcattcgggtttgactctacgcacatacattactcgaatatctaggtacgtagtattctttattcaggccgttaaatgtagcacttatactaaaaaggaagaagattaacagtgatgctcctattccatcccctcttcttgatttcatcaatagcacatgaaggatatctcggcgaagtgtggtgttttctttgaacccacccctttcatgcacagacgagtccccgattaaaccttctggtctgcaccaggggatctcagaaccccctcattgtgataagccgtaggcttctccttcacgtcattatactccgtagcgaagtcgtacagaggaggaaagtgatcgacatcagcgcggaagaccttcttcttgagataccagggcagcttcttggtgtagtatccagcatgatccctgtttctgacctcaaagacgttgtccagctcctcaagcgtgagacccttggtctcaggcagcatgaagtaggtgaagacgaaaccaatcatgttccacaccgcgtaccagcaaaaggctccggtgttgccgaacccgacgaccatgctcggccagctgaatgagatgatgaagttgaaaccccagcaaatagccgtcgacgaggacatgccaatgtcacggaagtgcagcgggaacgcctccgcagagtatgtgaagggcacggggccttcgctgggggagtatgccgccatgaataggtacaggccggtgacgacgcaccccatccgcgcttgttcatttgggatcaggaaagagaacccggtgaagaagagacatgccgacatgatcgggaaaccgacgagcagcaggttccggcgaccaaaggtgtcgatggtgtacacggcggggatcgcgaaaagccagtttatcaagccaccacccatcgatgcgagaagtgcctgcgtctgggagaagccagagtctttaaacatcttcgtagagtagtaagctatcacgttaactccgcagaattgctgcatgaacctacggtgcgaattagcattatacactgtatggacacactgtgtgtatgaacatggtgatggttggatggtggtgttttggtgttttggggatacaacttacatgcagaaccaggctgactgcgcagcacgacggtttcgacgaaccgtgaagaactcagtccaagagtgattggcacggtttgcccgctcaacctccagaagcttgtgggcgtagtacatgtcccgggttgcctggacggggagacggcgaagacggcagactgatctgtaagccttgtcgtagcgtcccttctccatgtaccaccgcggagactcagggcagaagtagacctggagcatcacgagcagcgggggcacagaggtggaggcgagcatccatcgccactgcgtgttctcgccgaggaagtcgaccttctcgaaggcgactgacacgacgaacccgaggcagattccgaaggcggtccacatctgccacatcatggtgagggcaccgcggatgttcttgggtgtcgactcggccgagtacacgggagtggtcgaagatttcgcgccgactgcgaaaccgagcgcgaatcgagcaatcaataagttggcaaagctattaaaatgcccgttagattgctgtgccaaaagcatgggatcgggattactgtcaattctttacttacttgttggcagccgccatccagaaaccggtgacgacagaaataaaacatgagatgaagatggtaaatcggcgaccaccaatcttgttcaggaagggattggtccagcaaccaatgagtgcggaacacagatacggggctccgttgagaagaccctgcaagttggcattctcgtcgccctcaatattgaaggtcttgtagtagaactcttgcgcgccgttgacggctgtctggtccatgccctggacaacagccgatcctgcacaaagaatacagaggaagtagagcatgaagggttgatcccacttgtgggtttcctcgcgacgcagaacaaccttctcctcttccgagatagtctcgatgtgctcaaaagcctgtggcgtgttgctcacctgggctaggagagcgcctttgcggaattcgtcatggtactcctggaggccattctgctcgacgaatgaatccacgtctttgagaatctcctccgtggtcagaccagcgagagggttacgcagcagggctgcagttgaggctcgccggttgtccagggcggaatcctttcggccaggctccttttccgtcgctccgttgctgctcgagttgtagcccgacccttcgcgggcctcggcttcgtgatggggtgccatagtctttagaacaccaactgttgtagtgtatactacttcggcttattaaatgaaattgttaagtcccgtagccgagcgaatcttcacactgagtgctttctcataaggactctaaacgttgtgccctcctgtgcaaagttattggagatgaatagactccagatgtcggtaggaactcggggagggagattgacccatatatatgcatttaaagcatccaaatgaaaatcctggagaccaattgctttctccaggttggacccaacaacggtcaaggcttggaaggcggagaagcggagtggtaccctgcctgtcacaggtgaacgcacactgtgattcatgtgctgatcaaagtggtggctcttagcattagactagtcttggaggctcggctgattctactacatgatctgtgtcttgataccatttgggatgcgatgcgtcatgggtggtggatactgtgcccttgtcgtaggattggcgccgattcatcgtctcccattacgtatattccgccagtatatatcgattgtattaaaggcttatcatcacatcatacttcatgtccatttgaaaagctgcaactcatcctgtcgatgtgttgtcgcatctcaactgataagagaatgaggcatcacttgagagacctgagattagtctctggcatgattcaagaggcaagctcaaatgtaatacagttacggtttatacactgtgtcgcaagaggctctgtgccaagacatgcgagtgatggcgccggcatggggagaattgcccgctcagatacccattgccgcgatatctctgttttcaggttgatgcctggagtcttggcactatctcattggcgttgcccagcctattctccagattaaaatctctgataaagagagagaggcttgcgtatcaactgaaaatcggtatgtccgtgcgatgacatgacgctattgtgcatttcaaagtccccccaattgtcgatcaacaggccagagcccgctttttgattagacgaacgcgctgaatgctggtaaagggattctgagtaaatgaaatcgcccaggaaaagcgagaagtctgttcctgctgactgctcgcccgaccgactactacccagtcccagctcccgcccagcacagaggcgatctcacagtcagttgaaagcctcatggtcacagctgggatttgcccggtgagatagaggcggctcacctcatcggaggggacaaagtgcagtgaagcccccaccactccttacgtcacgtttgtttaacctctaacgagcagatacctttctctcctgcccctgtctcgttgacgagggttgagaggtagacttgatagtaagcttaatttacgcgctacaccaactgtattttcgcctatcaattgtcccacctggtctgagggtgggcgtatccgctacttggcgcatcttggcagacaactgacttctttcccacacagtaaatagtttgttaggtggataagaaacttatgaaaggctccggtgacgtcaaagacttccccttagtgcaccgggcaattgccgcaagcagagatggctggtgttgatcaagactgcgagccccgccgttctccagtattcttctttgactctcacggcttggcagagcctctgatgcaacgcacctccgtcatccaagacagagaggctttccactatcagttggggtttagagaatgcgaggctttgaactgaatccaagctgccaagttctcgcccttgatcgtgtgccacatgagcgagtatgaaagttaattcagagtacgtcagagcgggtgatgccaagctttcagagaaactcgcgtgacttcgagaagcaaccttctttatcacatatggtatgattactcttgccatacattttcaatgatggatgaaaacttcattgccaagtggctgaaataaaacatggcatactctgaacgcttgttcacgcaaggcaggggacctaattttcttatttagcaatactcaacataataatcagaacataatagactatcccacaatatttaggttaatattgtaattactactaggtaaataatcttgatattgtgttgaatctcaatactggaggttctaggtgtgccaaactcccatccacttagcactgaaacacggtgataaatccatgcgggttttcagggtgctagatcctatgaaaactcaattgtcagaagatcatcgagaaatcgactagcaaagcccgctgagcttctggattccccgtttaatttaggcaccgaaatttcccatggggattgagacaattccaaggcaagtcgccccagaaaataaagcaatggtctccatacagtgcttaactttattatgcatgttccagacgtatcagttggtaagaaaagttggagaatgggagcgacctatcaatttggatggctgagctctgcttactgggatttccaagacaatggctgagaggcaacagttgacatttgatctttatggaattgtccatttctaagaataccggtgagactaggctagacagctactttaacctgcatagtgataagctggtcagtgggcgtcaaaataacaaggactgcaaaggtgtctcaatcctaacttccaatatagaccgcgataccgatagataatagttgataataatcaatgttttagtaattattgggcaatattatatctacttattattaagcgatagggagcatcattatgtgactgactgccacaataattctgtcgaggtgacttctgagcatagtcagaacagttgttatgtgctcgagaagatcaccaggccttggaacctccacaataaaagtaatgtacggttcgcaaaagcccctaaacggacacccactgcctcaagaatcctgctgcctgctcagcccctctggaaataagtgcacaaatgggtctatacaaatcttacccagctaccggggcgctcgtgggcataaaaacccgggcggaagggccttgatgggcggtctgcttcgccgagcatcttcaaaaaggcttccattttcaaagatagagagagatatacgcttaaattgaattatttcatacaagctaacccgctaacaagagcctggcattcagtcgaggctagtcgacgaagaccgagccgaaatatcgtgattttcccaaaagctgatattcaaaaaacaaaaacgccattgaaaacaacacccttagccatgaatatctttcccgtaccctaaaccgatgttcccctaagaatcacgtcccgttcctcgcagcccaaattcccccagagtaagctacagcttgatttcattcagcttggtaagaatttgcttgatgaagcggaagccgatggtagacccatcttcctcgtcatcgtactcctcgtcgtctcctgccagatctccaaagctgtcgttaccttcatccaggcaggtgaggcacgacagaacgacctgcgtgtatctctcgcccatcttcttggggagccgtgtcttggcgtactggaccaggaactccttgaacttcggccccgcagtatggaactggtaggcgttggagagctctctgccggtgctctcagtgtaccatgccaggaactcctggatgatggggccgaactcgggcttcagcggtcccgagacgtcggcgaatgtcaggagggactcgcacagcccgatctcgaagaggcagacccccaagctgtagatgtcgtgctgcattctatacttctcagtgacgttgaacccctggcgcgaggggtggcggtaaatgttgcgctcccaggccgtgtcgctcctcatgacagtgttgccgtccgaggatcggaaacactcgaaaccgacgaggaaggtagaccgtcgacgtctcgaggtcaaggcatcctcgttatcaacgacgagcacagactccgggcagatgttcttgtgcacaaagtcaaaggtgtggacgtagttgacggcctgcgtcagctcctttgcgacctgcacgcgccgggtcaaggtcagctcctcgcctgcctggttcgccttgaccaggagctctcggagactgtgcatttgacgagcatccgtgttcttgggggtctcgaagacgatatcgatccccgtcagccacttctcccgtctctcgggcgacctgtggaagatcttgatggcacccgtgcacttgagcagaccgaaagcgtacgggttggcgttcttcaatctgcgggccaggtcgcgtacgtcctcggtcttgtcggccttgctcacgccgttcgagatgtcgaccttgaccagaatcatcgacataccgctcctcgacgtggggaatttggagagctttgctgagctgtatggaatggacagtgtttccatttctctctcggcgagaaacaccgacgcgttggtgctgtccttggggcgaacggcttctcgaataccgccggccagcgccaacggggtcggcacgtcccagctcaggttcctctgcaaacctcggggggagggagtttccgacgagtagctgggcggcggtgtcctagtaggcgacagcgggaacgagccatctctcgagtcaagccctctggaggcactgcgggcatggtgggcttggtggctagcttgtaggccagccttgcgcagctcctcgtcgatcttagggttcgcattcagcatcgtcagataccaagtcgggtcgaaacggtcgcgccaatcatccagatctgtgatgatctcatccaaggtctccttctcccaggcgaacttgcccttcctggcccaccgctggaactggaaaatcttcttcttgccaccggggcccagggcgatctcatgctgctgcacagcctggatattggcattggcgacggacagcttcctctccaggaccttcaggctctccttgaagtcgtacctcagctcgggcttcatcacgggctcgatgcgctccatgaactgggcctgctccttcatcctgatccagacgctctccaccttgcgcgccctctcggcgagctcttgatctgcatgtttgcacgattcacagaatacgacaatccactcgccgtatctggaaagttgttagaacttgttccgtcctgtggatgagcgggagatctctaccccgcaatcgacccaggcaaaatacatccacttacttgtagcagttctcgaggatcgcgaacacggtgattggatccatgatggggatgagagcgcctgcgaggatcgctaatctggctcttctatccgcttcaagttttctaccggccggcgaatctggggcaacgggagggctggggcaggcggttgggctttatgcagctcgtccatcgacaatgctaccgcccatctaacccgaagtatccagattaaataatcagctcccacaaatgcgcttccagccgccgccactcgaggggcctaagcgtctagccgccagtcgagtcccggtctcgatgtagagctgagatgatgggtgacacacagccactccaccgccacactgggcgtttttgcggtccctaaacactactatggctatctctttccattagctacttatttggatatataggtatttatttgggtgtgtattgggtgtttatttgggtgtttatttgggtgtgctatttcagcacccatttgaaagtttagctcctgcttgcttcactgattttcttctattcatcacatttgtgggaaagaatgtcagataatgatatcattctaatatcacttgacgtccactccaggtacaacatccattttgattgagatggttagaaataatcaaattttaatattcatcaaaaaattcactgttccgtcatatctcgtgtcgccgacgtaggcccattgacaggacgggttccaggaggttgtgcccaaaaataggcctttgatacataacggttgtagggagcatggaaggcgtttcaacggcgtcgcaaattatttgcagcgcttcagctagtcacggactccgctaaccgcagctgcattcaagtacatcaataatacctacttgtagggattgctcaaggagctgttctgcgtttcctgaacagtttgaggtagatggaaatcttataatcacgaagacttaatctaacagtaatcgccagcgacgctccattctttctccttcaaccttttaccttcccccccctcttctcgtgcagtagatacccagcaagcgctttcttgatcgccaatagcgtcgttaccaccaagcataagatccgtcatgtctgaagcagctttatatgatatcttattcatagaccagtctcagaactgtcctgctccgctgccgactccaaatgacatagacggctctgaagtcttacccaatagacctggcagcgctcgccttgtcagaatacagcagaggtttattatgaagttcggcgcccacgtgcgacctatagaggcccagaacatgctatacgtggcaaaatctacaacggtgccggtccccaaggtctacgccatctaccaacgccgagagaagcagagcacagtcacatatatcgtcatgcaatatgtgcagggcacaacgctcatggacttgtggggtagcctcgaccgagctcgtaaaacctccatcgccaagacccttcgggcatacttcgatcagcttcggcagctagagcatccgggttatttcggcaacatcaacggcggaccgcccctcgacgatatattctcggcgacgcagggtgccaacgagatcaagggatcgtttgctaccgaggacgagctggtggactggatcattcgaatctactccctcgaaatcggcgagcgtgcggcccacaaggctcggtattaccaacatgtcctgccaaccgtccttcgcagcgatggcactcccaccttcacccacaatgactttcagaggaagaatgtcattgtgcgggatgacggagctctagtcattgtcgactgggagttttcgtcctggtatcctgtctactgggaatactcgacggcaacgtttgctaacggcctctgggacgatgattggcacgaatgcgtacgtatcgccttggatgaatatccaaatcagtctctttggttgtcaactataaagcttgaaatatagtcttagtatatatgctgtagatagttccgtctagatttgctctagacggtttcttaattaccgcgatcaaaatatatcgcgccttgttatcccgtcgccgctgaaatagtggtggccttcgctggtggatggaccccaggggggtgtggctgtttcgcaggctttgcttctggtcttgaccgcgcgtttggtagggaaatcgctggggtttatccagcgtcatgggctgccattcccaagcttgtaatgcggggttctcagagtagacggcgagtgtcacaccactgagcaagagaatgaacattcttctagtggtcaagtccttgctcgggagggcgtgattcagcctcaagctctgcgcatgaaaaacaataatctgcacatacaaaataatactctgcgcatacaaaatactactctgcgcatgcaaaacaatactctccgctaacggacaacaagctgtctagacggactagcctaagcacataatcatcactacaaactgggacgcaacattgtaaatactgtgaacgtctcggaaccattcaattttacaccaactctacttcaaatcctgcctgaacgcgaatatcatccaggatccattcgatcggcgtagcatacgtgacatcgttgatacctcgattcgtcggcccacccgtcaagataccagcaatacgtcccgacatatcccaaatacacgaccctgaatcaccacctgcagaaaagcccaaccttcctttcttattctcatcctgttttcgtcccacaatacaccattcttcactaatgaccactttcccagtaatcacttctcgggtaacagacttgatcgggttagaaactccaacagtcaaatcggttgtatgcccaaactttgccactataagccgaggatcaccatgtttatccaaggtcgtagggtgctgaatctcatgctcagatagaacattgttcagtcttaatgggtctaatagcatgtgaagggaaaaccgaaagtcaggtatttcctctctggttatctgtctcaataagagagtgtccgattcagccagggtaactatattttggagttccgagagcttcgatgggtgcttgccggggtgtagttcaatcagagcccaatctcttgatcgggcctgacctgacggggatgttcctgaactaatctgcggggaatagaggatatttccaatgatgcgggattccgggcgggtcatgctctcaaggtattctttccacatattatcaaatgccatcctaatctcgtatttttcaatgtaggcctttcgtttgtcctctgtgagtagagttttagtggacttgagtgcagcgatttctgattgctcaaaagcgatatgagacgatgaagcatcaagcatcgtcttgagggtggttgaccctggctgtataaccagtcgaggcgttgtgtctggatcgtgttcatatagcgtattcgactcgtgagattggtcaaagacgacatggcggcaggtcagcataagaattgctccggtatccttgcgcccgaggtaaaggcccttgctaccttccttagtagcattaaacgaggctatagaagcaccgagggattcgctggccatcgaacgatggtagatatttgggtggtaatctgggggggattcagattgagacaccagtaagggggcaggtggcgtcgctatcttaataggcccggatacagatcttgtgacatcagactctttgatttcgcagtgcatgtcatgaataccatattgctgcaagattcctctgcaacgtatagctactgggtatccttggtcccatgttgtactgtttggagcgacagaaacgagaagcacatggtatttttcagggtcttcatcagggcggtcccaactgggatccaggcctaacttcagaatatcgatcgctgtccaatcaagaccatcaagggcattgatgatctcttggcgcaaagccccgtcccaaagagatgcgatcgggtgagttggtgatgctgtgtaaagatactttttaataccccaaatggtgccgccattcccacgtttaaacttgatatcgagggagttggagcgcgcaacaagcttggggttgctaggaaggccagcaaagtacaaatactgctcttcagtgcttggtgcgactggtgcgactggcgttggttcttgcatcttgaactgattcttgaagcgcaaaacatcaaggtctggtgtttggtagactggcaacagcgacgcgatcttatttatacctaggcaggtaccaccaaaagttaatccatgtaccagggtcgctatgtgtaaaacacaagggaacttaagagtgagaaccaaacgactaggcagcgacaactggtggcggggagatccaaacttacacaagtgggtggcataggtaggaaatggcacacctaagcactgccctaacacacttgatctattatctttcatagctagctctagaattactaaataagactgaaggaaaagtatatacaggtctaaataatcatagtctctaacgtctgtttagaataagctgcttgatatgtatttagatatttatttgggtgcttatttgggtgtttatttcccatgtcgcccacttgacatacttccagacctacaaagtttgctattgctagccttagccaaagtctcatatcaaagcggtaaactcagaataatattcgtagagcttgacagagatgctgatcagcaacaagtcgacgaaaagaagaaatgctaccgtttgccgtgagatcgatcaatgatgtggctgtaagccagtaaatcagagacctcttacatccacctcaggcacaatcacatcctttgatcaagattttagaaataatcaaattttaatattcatcataaaattcgttattttgcctcatcctgttgtgaaaatcactgagacactatcgaagatccaagaaaccaatcattgaagtcttcatccaattcacctaaagcccattcccatttcaaggctaacccattccctcatgtcattcaaacatttgcaggtcgcttctcctcaatctgggtggtctgcccatactgctcctcagcagtcctctgcttctcggtaaaagcaacctccttctcatcggcatccttattaccatacagaccaattctgtaccagggcagctcaaagagggcatccatgctctcgagggagcgaccgctagtctcgggcacggagaggaagacccagataccacccacaatggtgacggcggcgaagcaccagaaggttcccttgggggtgatacctccgtctgtagtggagagaagcatgtttggcacagcacgcgagtttccgtactggttggcaaagtgcagggtcatggcccacgaggtagcgagggcacggattcggagagggaacagctcagcagtgagcaggtactgcatagagttccagcccagtgcccaaccgaatccagagacgtagatcatggcaatagcacctcggctggcagccttatctttgtctgggagaacgaaaccatcgacaattcccaattcgggaaccgaagtcaggaaagccgccacgtagatcatggagacggcttggagggtgataccagtgagcagtgcgcgcttgcgaccaatcacatctacaaggaagagggcgcatccaatggcggcgatgagcttgacaataccaaagatggcggtaacaagtagaccctcctcgctaccggtaataccaataagcttaaacaagtcgggagcatagagggtgatctgtacaatattacacatgattagctcgattcaccaagcaattatagacgaggtcaacttacagatccagcaccactccactgactgaggaattggaccatggtagagaggtacagacggtacaggttacccttgtccaggaacatctccttcagcttgccaagaacaccaacaccctgggaggcctcaagctcatgctcatgggcagcctggatggcggcgatgttgtttgtgatgtagtcgctgttggggtcttgttttcggattttggccaagacctctgtagcctgctcgaccttgccctgcttgataaggaaacgcggcgattcaaattggaaaaatgtcaagatgaaggcaattccagagaacatgatgtgcaagctggtgggaacaagccattggttgtggctgtggctgtcgatgttgatgtgggcgccgtagttggtgaagtaggcgagcacgataccaatatacaccgctccagtgaagaaacacgtgcatagaccacgaatagcagccggtgcaacctcagcgatatacacaggtctaattgaagctcaagggttagcgagaacgactcaagggggcaagtattccaatgggaacatacccaacgactggtgtttgcccgacaccaagaccggcgatgaaacgtccagcgtagatggctccaagacttccgttaatacctccaaccatgaagataatgataccaatggcccagagggtacagagaaatcgagtggcccagatacgaccaattctgtcgcagaccacgaaagcactgagagacatgttagcaacgaccttctgagaaatttcgacgacctgtcatcatacatgagggcaccggcgacggagccgatttgaaccatggcagagacattggccttgatgttggccttgtcaacgtcgttgtatgagttgtaatcgatggcttccttgaaatcagaagagttgaaagcaccggaaatgaggccttcatcaacaccacgggcagcacccaagaggccgaaggaaatgacggcgaaccatagtctccaattgaagactccctcgggctcgccgaggtccttcaacttgaagacgttgacgggcttcttgacaccaccagccatgatggaagatcaagggcgaggatctataccgccgctgaagagactgggtttgtgagacggagattcgccctgatggtagaaatgaggggaggtgaggggaaatgcggagtcgtgaggggaagaagggtgaatgagacgagcaaaacggtgatcttgggtcacggatcgtgtgccatttatactttgagaaagagaatggttggggaagttgacccccacccctccctgtctaactcacaacccaaatccattcgtgtcttggaaggtgcggtgatggtaaccgagtggacgtgggatcatcaaactcaggagtctgcttctccacggggagactctcggaaaaccccagtaatctgcgaaatcctccagaaggcgggccaatcaacgcagccgtgactaagatccagacctccccggagcgattgtttccccaaagtctaggcggggttgaaaacagctaatttcgtgggtctcggaggccaaaaaaattgccatgaatcagacggtttgctccactcagaggcaaccaaatcagagccttcgcattgaaatgcactggggaactgaggggtctcggtcaaagtccgttggggtcgatgtcaacccgtcagctttaagtttaattgcttagactgctgctgggataatgggcactaatggcaatggccttgaacatgacgagcacgcgtccgccgctcacgatagctcatcaacgtcaaccaagacactctcggatccgaggggcgaggggagtgaagtcgccttctcaaccaccacaggtattactgctgaccagtgtctttgaaattgggggtaacacgggtgggcatgtagcggagaaagcccgcagaactgatggggtcaccgaaaagccattggtaataagcttgatgtcaggccttgctcgcttgcgctgatctgaacaagatctgcgggtgaacagccttttctggcctgatcataacacccaccttgagaattccccagcgagggaaattctcgcagccgcattctctccacaaactgtgctgttgaactgagcttttcctgtgtcgttcggaaagtcggcacttagacagacgccaaggccggggatcccctgccgggacccataaattcagctccgtccagcgtcacttcggagaaacagtctgaatcatgtgtgcatcaagaataaccagaatattgaaaaaaaggaggaggggtgtcaagaagaggagggcaaggagggttcagttttctattatggccgttggttgtttataggtttcttgttgcgatggttgataatactcgttatgatcgagatggagccaaggccgaattcgacctccagcttcaagggtaccggtagtggagcagtcgtgtcgggggaggctctctcccacgcgacagaccttgtcgggctaccgccgctcacacacatgagaaccaccgaaaagcaccggatgagtagagatctccgacgaacaccgagcgtaataccgacgcacgcgacacgaggtcgttggcggcctcaaggctgatggagtagagttgcatccagccactcgaatgttaggcattatgcatcatgccgcgcaagctatcctctctagtccgtgttaatgggtctcatctcgaaatagtaagcaatctaatggcgctctccggtctttaatgtgtggtccaagctattacaagtctcatcctgggtgggagatgcatctcagatccaatatttggcccatatttcaaaatcttgcctctctccgcgaaacgtgaagtcgacttcgatcacatcttggaatccctcctttacttgcggaggcttgtggcgtgaagcaaagccagtgaatgcgagtttcggtagcacttccctttgttcggggttcagcgacgtattcagtgaccgcacggcgtcgttgtgttcgcaaaccacgagcggagtcttgaaataaacacaccgaatgggtagtttgaacccccgagctaggtccacccacaccgcgcgtgtgtcagggtcggcattagtattgtctagtccgagcagttagaaataagcagcaaaggaattagcggggaaagtccgtcctacctataacgacggaggtgccactgttcaagtgctcctttgccgctttgacgcacttgtcacgagacttgagaagatcctggttaattcgctcgtaccccaagggcttcaaggcgttccaataaaatgtgctcttcccagcacccggggggccacaaaacatcacaatgtcctgcttgtttgtcttctcaaacaagacttcagatgccccgtcagccttggtttcttgaaagggatatctcgcaagatcaaaatcccgagcgaagtccctgggtttctcgccaaggaaatattcttctggggtcttaaagtcgacacctgcattgtgggcaaagtttcggtctgagcaactgaaatctttggacacggctgccacaccgcctgaccctttgcccaaggacgcaattcttccgccagcatcccccacgaagaagctattcttcaagtcgatatctgcttccgagatatcataatcttcgcaaagctctttccacattccaatcctcggcttgcgatagatatctctctccgtagctgcatacagggtgactggcaagtcaagattgctcagaatcgcactgcatttctgcttgaattcgccaacgcgcttctgtgcgtttgcctttgggcctttgtatttggcgtcaaagtgcaatgtcaaccctgcctggttggaaagaatcaccactctgtagccctcctcattgtatagttgtcgtagtttttgaggaacttgactatcccaccacttccaatcactagcacttcccgcgtgcttcttccccgaagatgtccttacaagagtcgaatcgaggtcgaaggcagcaatcttgtgcctcgtcttggatttgtcctcggccttctccggctcgtaacatcctacgagaagtgttgcggggctatcgtcattgggccctcgttccgaccacgttactcgatctttaggcttttgtgaagtcggcgtgaagaaatttgcgacggcgttctctggagcggtgtcagcgcaagacatactgctccatgatcgagtccagaggctcactggttgttccgctctgtatttttcgcttgacctggggaggtgatatcggcgggtcagcttttcgcttgtttggcggacttggagaacccatgatgtacgtaaagcacgagtactaaggagcgtgatgttgggcatttgggggcgtgttcgcgtcgatggtggtggacgaaatggcctcttgtcacgacctccactattcttgacgcggggtcacgtggcctattcagcatccgcttggcgatgagcttagggaagcaccagttcactcaaacctcctacaattgatttagaactagaagctctgcacaagtggcacgccgttcccgaactctaaaagactactctaaagttccgtactcacaatatccttccctcaagaaaccagggccaagaaaaagcttcgcattttcacttcgcaaccgatcagcaaaagcccagacttacagctagctaccccaaggcgatgtacgagctcttcctcacctcatttattgaggatggcgacctcgaatcagcctgttccatcctaggcggactgtgcggcatggctccctggaagacagtccaccgggtcctctatttccaaggaccgcccaagccatctggcctatcaaaccaaagctcctttgagaagccaaccaggaaagacgttggcttcatgtggaaagagttgcaccaaaatctcagtcggcagtccttcattctccagggccggtatgaggtcgcaaaggaccgcgatttcggcaacccgtctgccttgtcaaatctggacatgatgaatggcgtgttgcggtggacagacttccccgaccctccccatagccggccgcaaattacacagcgcaagaaggtagaattatgggagcagaagaagctaccctcgatcatgcgcgacaatctttaccagtgagtccacatgttattacctcggtgagcccggacgctaagatgagacaggttgaaaacagagacagtagaggagatctaccaattttatcaagaggacattgaattttgtctcactcgtcactactttctgaagtcgattggagattacacacctctggaaaccagaaatgagccattagacgggccgattgtggcgctgccaccatgggaatcattgacccgggttgatgctcaaggtcgatgggtgcttcaagtgaaggcacacgtgctgcaggataataagccagacgaaattaggaaagctcaggataggctcatggctattcgtggggagcttgatggcgtatttgatttcaagaccattgatcggaaggttcatgacacccgagtcgctctgcagcaaccgggcgtgagagtgttgccccagaaagtaaagctgggcaagtaaccaaactattcccttcggtcacgaaaaagggtctccaaaagcagttgagggtcacagctcacgcgtctcatcagtgagcatcttgtaatgtgtagtgggagggctagtggatgcgtatcaaagagaacagttgatgaattgatgacacatatttcctactctacgttcccacctagcaatcttttagtagaaaatcatcttttaggagctcgtacacaacctatgccactgacccaggtcgttctatcgatacgacccttgaattgcaatctacatgtagtcgtggatgggcacgtatcagcatataatgtcggaagtagttccagggaattttgataacatatctctaaagttttcccgtcagcttcactgcctacatcacttgatcccaccaggaggtatggcgcgatatttcaggacacctaatcaacgatcggtatttacggtgtctgaatctgtcagtccttacctcttatcggcccagtcctcccaccaaacgaagacacacattcttcgataattgtattaccacagtgatgagacgcggtcaatatacaagttgcgagaattaaatgatcttctctccaactctaaggccaaataagcttgacataactccaggcgcgctgtcggactagccaaatgttcttatcatcaaggttaatgataaaggagaaacatatatctcctctccctaaccttcataccacgccattctcccgtcattcaagacattctcggtattcttgagtacggtgccacaatcaagtgcaagatgccacggaacatcttggcaatcgttgttgacgtactctaactcttgttgttggctccttatgtctaagcgagatgccttaattatcgctaagtcttttccattctttaccaagactaacactgaagattacctatgaacgtatagtttcaattcttaaagtgggactataaacaacccatcgatggttgagactttaggcgaaagcactcaagccttagttttcacacagtcgcgagccacagactacttcaaacgacttatccttttaaagtgtctggagagaagacagcagaggggcaataaatcgaactaatgagaagaaatatatttttttccaaatttcgggcatgtacaagacagcttcaccagcaaataacctactatagcctcctgcaagagcagcaactgacatagaacacgacatacctagaacctcaagcgttgaattcaacacaatgttaaagtaatcaatgaagtaacaaacacaatctcaagcaaaatattatagaaaacttaattattttctattattatattcagtattattaacaagaaaacgaagtccctaccatacctgaaaagagcttcggtataccatgttttacttcagtcacttgacgattatagaacaagcaagagactcgtccagggtttttttactgctcacttggcccacgtcgatgctaagaccgaaacagttatcgtcatagcaaatggcgcactgaatgtgctgtgcactcctgccaagtgtatgagggagaccgattttattcctcctcataaccagctaccagcgcttgaggatgggtttccccggcaccaacttcccacggccagacggaaaccaccctgaccattcgtggccttactactgggaacataggtcaataacttacactaaacgccaagaaactgaataagggactgcgtactgggtcagttattacttcatgatgctcgaggcccaccacaagagcgtaatacattatgttctattcccagccatctacacccctcaacggcccatgcttagggagtgtctcttagagtacctacatcaattaactcaaggtagaggcatcctggcggggacataccttccgcaagcaaacaaggccagtttatttaaggtagttgtctaaattgttattttaagcgcatcgtgctctctgcttgatgccaagaacgtggaccacaagagcaggcgaagtattacgcttactacagaatcaccaggcggcaagaaccgtcagtccactatcacaagctcacggcgcagttggtaagtccactcgacggttcgccggctcaccaacaaacagtgcagcgtgggggcagaaatcggcacagcacgaggccaaccacccggcaacccggtggagagaatggccaacattagaaacaggcagagttcggatccttctatagcgctgcgggtgcatattcttacgatatcgtcaaaagccctgttcgggacaaggttttgagggcaaacgtcatctgttccctccaattcggcatggcccgccatccagtcgactctaaatgggactggcggtcactcggtcgttcccaatcaaggagtattagataagatcgccagggaagtcccacgtggtttttctttcctctgccgtccgaatgatctgttgggccagcgatcctacctattcatagaactggcgcttgagctatcggcggtagagcggcagcagaccgccgctcaacacccactccagatggagacgtttgtcccatgttcgttgactcattgtagagcagttcaccgcaaagcctcttttcctacacaggaaagtccatctatctttgttcgacaggccgctccagatggcgttgtctgctcgataccccgccttccttcagggccgtccaaataggtttccaccgcccgacgccatgtttgacttgctcggacaccacctcgagcccagtctggtgtctttttccggctggcgcctggcattcgtgaggcagatcgtcccattcaggatgtgccacaggaagcccttccaagtcgaccttccgaaacaccattagatcgagagtcgcagcgaatcccaccgtatcacccctccaccctcccaatccccagtcaccggagtaaaaaaaaaataattgcccaccagcctgtcaacaagaaacctgtgcagggccaacacccattcccagagcgccaagtgcgaatcccacccgcccatcaccgaacaccacctgcaaccttggccatggcagcccaacaacgccaatgacgacatcaccggaacctgctgcagcgcgctgaaagcaagccacacaccacactcatcacatcacaccagaagtgccgcccgcaaccaaccacacaacaaagccgaccaacggaaaacaatgacgcctcacctttttctgtttttgagttttcctcccttcccacttccctcccccctcccttcttctctctccctagcctgcaggctcccgctgccacccactcccccttctcttcccccccccaccggcccaaccaaacccaaccacactcattcgctcatgcacaagatctcgtaccgcccttctgcctaacccaaactcaaccttcaacccgctgccactccagcccccatcacaccggctcgttggcatttcccgagcatcacgcacccgcatatgtccctacgcgctcgctacccctcctcttcgccttggttctgtttctcgtgttgagaagggaggagggggggacaacgccccaaccctccacaccggtcggtacgtgttcgcctgtcgagcatcgccaaacccatgttgaagtgccatccagccatcttagtgctactacccctcccctccctccgctacatcgtccccacggtggtcacagcgtcacccaaaacccacacatacccgcgctgagcaccagaacgcaaagacatacgtagatacgtagatgactctcccaccccatgtagacagcgagttgaggtctgggcctccccttccctgcttgcattgtactcgtacaatcctccctctccctgggatcctatcgttggagagtatccgagacaatgtcaaacatcaagtacatgcacatatccgaatgaggaaacatcaagtagataaaaatgctttttattccttttttttctttacttcctccttcgtcattttgacgaggatcccgatgtaactgagacacggacaaatgtttgtttttgtttttcttggttttctcctcgtcaccctggtggccaccaatgacaaccaaggccggagagctgtgttatcccccaacacacacagcagacgtgcttcctccaccgcccttcccttcgcacattgaacccgtgcgaagctattcctcatgtaaacagtaaacaatagagccgatgggaaccctgtagtcgatctcaacaatggtccacccacccatagaagaagagagaattcactgcacagtgtaaagcggccttttctcttgatccaaaaatggacatccctttgctcgattagctattaagcgtctcgccctactgccattggcacatcgacagccatgtcatccccacccataataaaaataaacaacaaaaattaccagatggaggcgcaatggtcgcctaaacaaattgatacaacactttttgttcccgagccctgtcggctttctattccaacgccgctgcttctatgtacaagcaatccaattccaaatatgtaacaagaaaatagtagtccgtaagctgtaatggtatccagttcgtctattcaacattcgtcgtttcgcgtagagagtgatttgttcatcaagtatgatagtaggttggaggtcaggctttacttgcgcaggccgacccttccagccaggttcttccagaatctggcgccatatttttcttcgctgtgcgcgcgagacatgggctcggcgcggtgcatggggcccacaatgtcttcgtcacctcgcgcagggaacttgccgtcgccatccatcatatgcggaatggcgctggaaaggccgtcctcgacgcggcgccactcagcctctgcgaaaaggtcatcctgagcaggacggccccagaggacagcccctgcgctgtcagatcgacctcttccccttgttcggccccggcttcggctcctagctgaggttgaggaccggttcgcgcggtgtcctggggttggtcccatgaactgcttcatggcagcatcgtaggtcgtccgccattgcgactcgatctcggcccatttgcgctctgtaaggccgtaaatagtgctcgtctcaccgtagttctcaccggtgcggacgatgtgttttgtgtagttgactcgggcagcgtcccaatccttgcggaattgcgtcaaggtatcgctatccacaagctccagctcataaggcttggggttaatggtaaagtttgcgtgacccaatctgtctgaccactcatcatactcctgcaagagggcaggtaaagtagcaggtgtctcgacagggagatgtcgcaaagatgtgactgaaggctttgcgctgagcgagggtcgtgagaagttggtggtgcatgagggcggggagtgaatctcaggtgaaaaggctgaaggagcaattgtaggagattgtaatggagattccttggggggtgatgcgaagggtccattgagtagtggtgggaggaggggggttgtcgcctttgcgcgatcacgctcaagcgtaagccgttgctccagctcctcatcttcctcctcttcgtaccgggcagaatcgctaacgaggctctctcggctctcgtagcaagatccaggataagtcgtcagcttgggcaagtcttggagacgatctgacatttgagggcggggagaagaaatcgaagaagatcggcttgatgtcgctcttgacagggcagtttcaagactgatctcggtcgtggcagctgatcgcagcgtccctctcttgttcagtgtccaccgattctgcgactgcaacttggagctcagacgagacgtaagtccaataaagggcagctcagtgccacttcggttctttgaattactcgataggtttactgataaagcaccgtcactgagacaatcccagtcgtgatcgaactcgtagtcagtgacaatgtcgccaggaaagttgtgttcagagctgctgcgatgttcgcatggttcgtcgcctgtttacacactgttagtcttacttgtgcgggtaccaaaatgtggtatttcttacagagacagctgtataatccaaagctgtcattgaaatctcccaggacgtcctccctctcgaatggctcctccttcacatcgggcagtggtcgtgcaccggtctgcttcggtgcttgtgatggtaccggcgatgcagggctctcgaggcattgtaggtaggccaggtcgatggatgaggttgagctggaggtgcggtagtgtccccttgaggaaaaggtaggcgtgagaggcgtcgcgatgtccgaggaagaggaattggtggtgtggtaggcgtaggccagctcttcttctgagcacgtgtggtggtggacctcgagcttcttgcgctcctccaccagctgcggcagcagcaaaggcttcaagttcgacgacgacatgacgggcaactggctattgagcacagtgctgcttcagcagcgggagcaggcgaaagcaagcagtaatatgcttgatcggtgtgcagtgtgcaggcgagtagaggcgagagatatgaaggtggtgctggaaaggaaaaagcacctgggcaggaccaaaagaagtagtagcgatcggccgtgtggcccgggagctaaggtaggatgcgatgcccacaagtacgctttggcttcgccccaactcgagttggtgcaccgggttggtacagaggtacctacagggcagggagggatggaaaagttggtgaccggggggggtgggggaggaaagtacaatgtcgatgtggggtcgtcaatgcccacctaaaaaaaccatgcggtggctagagtccaggatgggccagctccccttccaggtctgtctcggttccagttgtctggctggcgttgactgatgaatttagcacgcgcggaccgggtccccggccattcctaggctgttggacccaagagcgattgcggcgagcagaccgtctgtctggtgctgatgtctgggctggaatctgcgactggactgaccaggcggagagtcaggtaaaatttgagaggcaaaaaaaacctgggcgcgaagtatccgtttgcgcggatcaagtgaactcagtgctgcgcgcgaactgtgaactgccacaggtggctgaggctttcgcagtaaagtgggtgaggtggtgtggtgttaaagatgatgactgatgacgactttagtccgaggacacaattgatgaggtgcaatggaggcgagtatccgcggcaatgatcaagacttattcaatgcggtcggcatcgacatttacatgtgctgtgctggatacctgggacgagagatggtgttgtccgtccacgtgttgtgcggttgggcgcaggtgcgtaccgtaggttggtaggggcctggggtgtgttgtttgttgatgctggtcaacgccaatcacatacaggcctggttctggcccagcgaaggtctggtctcgtgcgtccaggaagtaaagtcggtgactggaacctgtacgtgacgtgggagaaacggtgaatggccggcaatcgtcagaaatgaagggttgggacgaaaaatgccacaatcgcgtcgcgaatggaagccaggcctgtctgtgctgatctgctgggctggttggtgccaatggctgggctgggtgggtgttctcacgtcggtcgcttcgggcctctggggagtgtgtgcgttggcgtcgtgagagcgagaaaaggaacaagccgtttgagccaccccgaacggcaatgcctggaacggctagcttcagtgagagtcggttctaggctagaccccgctgagtcaagcagatacagaggccgttgagtcagtctctagcaaaggaaatatcatccctagccgatgatgagacaattggaaagggcagatggcggagaagacatgacggccccaattggcgtgtgattctcgacctccatgtttataattccagccaaccgacctacatggaccagaggtcgagccactggctgttgcacacctcccacccactggtggtttacaacagctcaccgtgtacgtaagtacccagtaagccctctgggtcgtattcctccacctgacgggctctcaaaatactttcttacgttgtaggcgcaccgctacagttctagcccagccttctcgcccaacccggaggcaggctcccgttccgagtcccaccccgcggaaagactgccaaagaagagagaagaatcagagagagtcccacccacacgttctcgatcccaccattcacagtgcgacatggtattttagcctttgccaggtcgcaggggtcccccaagaggatgcttcccaagccaacagccaggcagagaccgccgtattcgagggtacgtaccacggcggatactttgcccgagcagatacaagggtaaccaggccgctgctctgtatcaagcctggccacatgtgcggcgagcggaaagtgctgggatatctttgagaggttgcttttgcgaagtgatgctagccatcacgtagcgagcactcgggtgcgtctcgcagccagtagaaatggcccccgttgcacctgcagcggagctggaatgcggcctcaggccccaaatccgatcagtctctctccctcgccgctcgctttgctttgcacgaccaggctgccagccacgtctgaaatgcaggccgatgtgcgcagggccgtccctcgccattctcttcgctggcaaaagatcaggatatggatgcattggtatgacccgcgatcttctcggtggaacatgccaatggatggttagcacctgacgctgttgctaagaatggtctcatctgcccacactcccaaaaagtatcatctagtcagaggcatcggatgccaaaaacaagaatggggaggcccatcccataccattccccataggaccgaccgacctgggcgaggcacggtaatgtaacgcagaaacacacatggctttcccaacggtaatgcgttgttagcaacaatgcagttcggaagccaacatgaataaagccctggcttgcattggaatggaagctgcatggccaacagtctcagctggctccgcatcacctcgcaccttgtctactcgccgccccagaagtccctcgatttttccccgtcctccagaatagaagcagtctgggccggcaggatttacagagctcgctcgtgctaccccctcctcttcgttcgcatcttgcgcacctgcaaggacgaattgggtgatgtatattattgtccccccagtcactaatatctggtcaacctgtggtggcctgcatcaaggccagatgccgttccgcgtccacccgcaccgctacgaataactcttctaaggtgtggaaaaggaccgagagggagaagagatcttggggaatgggagaatcgccttggcttgctttcttcttttgatgtggcatccttaatccatcgggccttgctatgacatacatacacgagcatttgctaccatatagcaccacacccaccaatcgcgacaagttcgagatccatttttccctattcccattgagatagtgccattggcccgtgcaaaaatattcctgtgggtttcgcggatgtccgcgatgggcttctctttaactgtaaacggtcagttttacaaggcatttgacagcgatcgtctctcgtgtcccggaggagcgggtcaattcatgaatcatcgagattccatcgtcgggatgcatggggcaaggtagcagtaaaacgagctagcaggactgctgtgcacattgatacacaactgctgtcccatgcataattcgcccgcccaattcgcttgtgcgctttgtgccctcgacctacctcatgcacaaaggcgtggggagcctatcaccaatgatgtaaagcagctcccgaccctggctgctttacacgcagtattatccatacaattggcctctctgggttgctacgatgctaactcaacacttcagtcagggtcaataccccagccaggtcgcgtcctgtcattgcagatctccgaaagaatcaaatcagacgcgtcgactgccacactctaagttccatggcatgctgtaaggtacaaactttcgtcttgcacctcagccggcccagaaggccagccggtgagactaggagggtatgatgtgacccgcgctgtcttttttagagttcagcagtgcgttgccgcccttgtaacttgctggtagtgccgtctctcgtctctcctaggcccattgtccatctctgaggccaggctcattctcacttaaaaggcttgcagcacagggcggagcgacgcgccccgcatgatgtgccattgtccattgacaataaccactaacaggcatctagctagaagaagcataaacatccaccacaggcacaaactaccgcccgttgtcttgtgaatgggttgctggtcggcgctggtgtttgtttgtttatccgtgtggcattgtgcaacaggtgcttaccgcttctggctggctgtgtttccctatgctgcccgctcgtacactccatcaggcccattacaagacgataaacacgtttggggtgttggctgggcagaggccgttgcgacgcttcaggtcgatgctgccgtcgcagagactattgcattcaatggcatgcacctgacagcttcgttggtcctgcattgcagccctttgtgaatgccagctatgtaatgctacgcgcacaacggcctcgcgtgcgtgcaggcaaaaactctgttccatgcctgctccctgtcaccatcgaatcgaacccgtgccgtggggctgggccttgggctcgcgcttccgtagctgcccatcccaccctccatgttaatgttgccggggaccaaggcaggctgacgagtaatggcgagcctgggcccccgccgggatggatcttgctgggcctggccttgccttgcctcgagtctttcgcctccagccctcgctgtcgatttcaatgcgaaatggcgagacctctggatcgtcatgcgaaccatcggtctggagtgcatccgtacacctcaccccctcggctgccacagcgtctttcaatcgcatggcatcgccaggctgtgcgtgctgaagcgactagccatgcataatttctgccttcgctccacctgtcagggcaaagtgacagataccgatcggaagtttgcccaccacaccaactgactacctcctacgggtgatgagcttggtcggaacaagcactgcgacttcgggctggagccccgaagccagccaatagcgtgtctagatgccacgctagaagtcagcgccagggcccttcccactattctagcctgtatgtacctgcttttgcaccacaccctccgtctctgtgccggcgcgaaaggatgacgcctcgtcaacatggaaaaagtgacaagtctcctgcaccatctcatgccgtctcctcattttgaacagaacttgcgtgcacacttgtctctcggagcccagtttttgttccttgcagaattgggagctcttccgacccgggggagcaccatctgacggacaagcttcgaagaattgcgcttggctcgaactggtcaccatagcctaacgctctgcctccgagccaaccaccacagcgcgcattgcagaggtacctcggggaaaagccgcaacagagtccaaggatgacccttggccactgcgttgggcgcactgttcccatgttttcccacgctcgtgcgcggctcagctgctgccatggcgttcagcgtgcacagggcagctgactccaacctccagtggtgggagctccccgccaggaaacgtccaattgccatggtctcaacggtttccccggccctgaaccttggcttattaacgttaagctgggagataatataccacgtacggagccctcattcggccatcgactggagagattacctggcccagtgctattggcctgggtacaggggagtgaacatgggcctgggagcagcggcagctatccgcgggagacggcttttgtcctctccccttgcagtagtacgtttccccccgggatggccatcgtccagcctcttcactgaacgcttcgatccgcaacggtgataagcctcggtcggaaggccatggtgctcagctcgaggtagggtcgcatatgaatagggtgatttacggcgaccggtcagcagctgtgccattcggctgcttctgttcacataatgaggtgtggtggggtgttttctcatgacagacgacacacacaaaaagcactttttaacgagagaaattttttcaatgtgggaaaaaagcaatgcggcattggggcgtgttaccagagaactcaagtttgttttcctccacctcttcctccaggccctatggtactacagctgcgacaagaccatgtggaggacggcccatcaaacggagggggcagagccacgttcacaaggaacggtaaccttaccatcccagctctgggtgcctgacgatcgttgtgtgatctcagatgcgagaggggggaggtcctcctttcgcactgatgctctcattcggagagattcaggggcgtggaaaaagcatagccgcatccggcttgcagatcctcataccgatttccccccatcttttggcaatgagcttcagtttgagatgtaattttttcgcgtactgttcttttcttttttgccttctcggtgctcccagtggcaaaccacggtggacggcgggcggaagcatgaatccgattgaaatccgtgcccacgaatgtgcctctcttgggcatcagacctgccagcggcaccctttcggcaggcagagaagcccgaagctggagctgagatgaaaaacgccaccggtgtcactggttgagtacaggtcataggcgggtcacacctccactggccagtcagcaatcgcaaattttgctagcaccagaccggagcatcatcggatacctcactgcctacagtatgtaggagtcacacaccattacaatccactactcaatcgctaagaaaaccggcgggacgtttagcgtatctgactgcgaggtacccgcgaagacgccatcgcactgggccccccatcgggttcccactgcagaaatcaaggaagtcccttgaaaagaaaagagagggctgttctgtggattgggatgacaaaacaaacatgtcggagttaagggcaacgggtgaggcgggcgaggcagggcagggcggccctcaccaatgacgtcgaggcgcccatgcaggtcaggtcgtcggcatagcacagtcacataaggatgtggcaggccttgattcgccgatcacagcatctcgtctagcatcaggccgtgaacgattgggaaaagcaaacatgcaaaagaaaccaggcggggggggacagcatcatcatcagcccagaacgcacgcagctggctctacagtgcatcaccaggtcacaagtcccattccacccggctctttgttggatgcattgtgtaagccgccagcagccatgataccatttttttgtaggccagctcaactccaagcctgcaccacgtagacgtgaatgtatgtgtgcgtgtgttttctcaattggattggaaagggaagtctataggctgagccaaggcacactgctctgctgtatcacctcagcacgttcctagatcagcacctttttctcacgctcctcctcgatggcccgcgtcgtttgacacagcctcttctgggcgccgaacatgttcgtagctctctgagtgtctgggtgcttgttttacgggtcgccctccaatgaacagcgcttgggaagatggagtgccactcagaaaggccaattgcattgttggctgatctgagtgtcgatctcctccattgtacaggaccaaccgatcgtacggggaacaaaggaccttttctcgctttctgaaacagttgcccacactcaattaatcaaatctgcattatcacctcgcagccgtcttttcttttgtctacctacactgcaattcagaaagtccgcaactgcgcccgatcctcccccctccatactaccccgcttccctctgatgtcgccggtccaactacatgaggcggcgtttacgatcatcaaagcgaccgatgctcgcccgcacatgcatgaccagctccgaccgcctcggaggccagtcgcgttctattttctgatgtccccggcgtaatacctgagctatatcctggcccgctcattatcaacaggatcatatccgcgatctgtagcattgcggcagcggttcgtagagccactacgcccgatcctttcttacgtgtgcctacagggtgtgtcaaaaataaacatacccagccgccctctagatcaacatgtggcagccctgagcctcccgtgccgtccgacgtttgcgtttcaggccactgactggaagtattatcccatctgacattccggactaagtttaatggtttcggtgccgttgtcttgtcgagccggatcggcaggtctccaagggtcacgcacgtggtgtcagtttggtgtctgggggccctggcctgcctctgatcccctcggcggtgcgaaccgtcttgtctcgccaatacgtctgctgcttcaggtggcgatcctatgcttcctcgccaggtggaccgccttctgtctgcgattgtatcttccgtagagtcggcctgtccagcgtcaagggtaaggctggaacctgaaccatgtgtatctgttatcgcactcaccttccggatcaatgtgttagacgctcgtgggatttccccgcgaatgtaaccttgatcggtcctacgctgagctattatagaaccatgtcgccgacctcgatccatccgctaggttcggtcccttcggtcaataggtttgtaggaagggtctaattataactcatggtcacaatcgtcatgaacgtcaaatgcccgtctcggctcgaaatgagacccatccttttcaaataacactctagaaaggacttcacatgaccaatgtcaagaacccgcgttagcagctttcgtttgggacatcattcaaaatagcatttttgagacgttgcatggtgagtttgtctccagtttagggcccttacaaaccggaataccaggtacctggccttctgcgagaaccctgggttctttcttgatgagcatatctggaaaggactgtatcttgctacctggatacttttctagccagcactgcatatcccgcatatgcctgtctacgggcgaaatctagtgatgcccttcttagaagtgtagtagtcttcaactagaagcggtctaattggagagggaaaacatagtgaaaatgcttgaagaatgacagacacataataaaaagtcttattacctcctaaacttgttaccgctttgtatcagctgctgcaactatcctctatgtattatacttggcgtaacgttgctatcatgctcttcataatgtgtatctaagtaccggttgggcagttttcaagatccaggcgaactcagccgcagaagagggctggatgcaattctgaaatcaggttttccacaagtacatagcttcgatcccaaataaaacccttagatctctgcgctgcgctagtttttaggccgataaatagatgcatctacaggactccgatgatgtcggcagcgggggccgagatagggtagttcacgatgcttgcgcagctcatgtgcaggcttgttggattaattggttgttttcgggatctcaagacaatggaacgcgcagtctcactttgataacggtgaccatcattgcctgaaagaaacatagatcattcaggaattgagtccggtggtggtctgaattccaaggcggtccatgacgtcaagatactgtcttagtctgcgatgacgatcttgcacgagcttaagccacgtactttccatgcaggagatcgtgacttctttgttatgttcgcttggccccaggcatttgtatttgacgtaggcggcaagagagagcttgagactctccggtagaggcaccagaaaccagtttgtgtcgtcctgttccgtagcacggctacatccatatgcgaattcaggcgtcatatcatatccatatgttctcgactctcggattcatcaatatctcggtcactcgataatacaacatccatacctagccaagcagtataacacctttcatccccacatagagcattggcggagatagcatcaccaatcgccccccagccatgtctgcgccggacagtaacgacacgggaggaaactcctcggtggctcggccgccgctcgtcccaggttctgatagcgagcccgaaatcgtccacagtttcgatgaatcgaagccaacagaaagccatgcgcttgctgaggacgcccaaaccggagaggtcgaccagaaggggagctgccagttcaatcacaacgacacagaagtgaagaatttgggatggaacgacgacgtcgataaaattcctcaacccctggtcgggggcatcgagaatgaaaacctttggacgctgattcgaagattcaacaaacaaatattcgtcgtcaaaagcatcgaccaacctccactggccaatcttgacctaaacatcgccgacgaggaggaattctccccagaaaagctacgcgctcagttggagagactctatatggttgtgatcttgagtcttttgggtggttggaaacatgttgttcgacttcgatcatggaaagaacatcagcgcacttctgccttcctcgctgtctactccgtagcctggcttctggacttactcatgccggttactttcttgtttttgatcactttggttctctcaccagagtcgcgcgaattctgcttcccacctgctccaatagccctaattgatgaagccacaggaggtcttaaaaaacctcctgctggtgttcttgggtccgatgatacattcactggcgcacctgaaaagcaccgtggagaggctgtcgagcaagaagctcatagcttcgtcaacagtatatcatcggtatgttctggcgtaaggcgctcaaccgtttctttcatgctcgtatggaacactaactgttctctagctggtggtcagtacagctgcgggcaaacatcctcaaggcgatccccacgaaggcgattcagcgccagacccaactgagttaaccatggaagttacgcacgccaaagatgcaggggagggcgaggtaccaacacatgagcatgataggacaaaggctccggtttctcacgctgtttgggatcgagcgcgcccactcatgcacgcagttgcagatgtagttgatacatgggagagattcgggaatgctcttaacccaacagtgccgtttcccaagaataggactaggttgaggcttgcggcctgtttggtgcccctgcttcttggatcgttcttgaccacctcctacatgctcgtcaaggggatcggcttcgccgtagggtttggattctttggttcgcccattacggagcctaccctcgcctacctcaacacaaactaccctcgttggcaggagcatttgcagcttcgacacagtattcttagaggtgttccgaccaacgcacagctcactatcacattgcttcgggtaggagagaagaaccacgctccaattcctccgcccccacgatcagatatcccacccccagttaaaccccatgagacggctggagagaatctggatcatctaggtaagtgctaatcataaagtcggcagtcaatcagcttaactaacagtgtcagaaggtgcaacagatgaagaaatacaggaagccatccatcccgacgaagaagtactgcaggaaaagcacgagcctggggtatcaaaaccgaaaacagcccgacgaatcctcaacctcatcaaaggtactgccaagggaggcgtggaaacagctctggctgccgacaaagcaaaagctacggctggagctcgacaggctcgtaatcgcctgggggtcgtacgcaaaagcaaagagattccagcacgagggcccgtttcgttccctgcccggttcaagggtaagaagggccacgtttatgtgaccaccaaggccacaacacccgcggtgagctggactagcgatctcggggatatgaatccggcctggacggttgcaatcggcgatgtattagaattgaggaaggttgggggcctaggctggaagagcaagcttatcgttgggtgggctctaggaagcgaggttgttgacgggataatagtgaagaccaggggcggtgatgaattacatctcacggcgatcagcacccgcgacgatctcttcaatcgccttatttctatgggcgggcagatgtgggaggtctggtaggtttcgagattgtagggagctacttagctgtggcacaaacaaactgctcatgatggctgtgaacactggttgttttgtatcaggtctattcaggatagtgtgaaattacattcagctgctgttatcagcgtctacagaaactcctcttgtgactccttgccctcttaaagccaggcaagcttccccacatggattctccccgcgtaatagtgaatgcgtgtggagtctcggagccggcgatccgcagctcggcccgctgaattcacatcgtatttggaattacatgtaaatagctagctgaaaagggtgtgtcgtgcgctgaaagaggtggccgagagcgaggggaggaaaccttattaagcagtatctatttgtcatgggctgccagcaaacatggccccgcacgaagcacgacggatacgaaggcacttcagcttcatctagcgggatagcatcaaggtagcactggtatgcccacccactcttgcgtaagtgggggggtcctcgatataaagctcgttcaaaagactgatagaaggtctcttcgcaaccagacacccaagcctccctgattctcatcagataccaacgatcaccatgagcttcacgttggagccgcacgacgccgccacttcagcaacatggatagtgtgccgaacttgcgggacgcaattcccaacttcggaccggcaggttgtcacgacgtgccacatctgcgatgatccgcggcagttcgtgcccccctccgggcagtcgttcaccacccacaaggaggtggcggcgactcaccggaacgagttcatcccctacgagccggacccgcggctcacctccatcgtgaccagacccaagttcggcatcggccagcgcgccatcctcgtgcgcacgccggcggggaacatcctctgggactgcatcaccctcctcgacgaggagaccgtcgcccgcatcacctccctcggcgggctggcggccatcgtcatcagccacccgcactactactcgacccacgtgcagtgggcgcgcgccttcgcctgccccgtgtacgtctcatccgaggacgcgtcgtgggcgacgatgccgtccgcgcaccggctgctgctgacggggacggagacggagatggtccccgggtccgggttcaaggccgtcaagctgggcgggcacttcccgggatcgctggtggcgctgttcgacggccggctgctcatcgccgacaccatcgtcacgacgccggcggggctggggaggtgggaggtggacgggaacggggtcgcgagggcgcggccggggggtctgaactcgttcacgttccagtggagcataccgaacatgattcccttggggccggacgagctggcgaggatgtggggggtgctggggggttacgagttccggtctacgcacggggcgttccttgggtttgatgtcgaggatgagggggtcaaggggcgggtgttggagagcatgcagatccagacgaggttcatggggtggcctgatcacccgttgatggggatgaaggtgtaatggaagaggtgcttgtttgtatactgttatgagaatatgtctggctttgtgggaggggtggaaggtaatttgggtgggaagagcgagtgaatggtagtgtttttgagtatttgttattgaatttgttttgtattaaattgaccaatacaagatatcttataaggagcgaatagtctcatcctatccatgtccatgaccatgtccagcctggttatccaaaggagcgtcctaatatgtattatgtatttgatatttttcagtttaccatcccgccaaagagtccaatttgaggatctagcagatatagatcctttcccaactccatgcttgcagaaacgctgtaaatcacaatagggtagaaaaggtaaaagacgaaagcaaaggtatagtggttgaggcggtggcctttttttgttgatataagaacgtgctacttgtcacggcgagaagcatcacgccatggcactcctcttaaagaagttgggcctatgcgacctcttggccggaggagaaggcggcccagtgtgacagaggaagcggttgagcttttccaggccgtcctggggcagatgctccaggacagagctgttgagggtatcaatgatgaagcggttggctatggaggaccaggtcagtgtcaattgtcaattgaggtggcaaggtgccattgggttgtggggtgactcacgcatcaggttcacgccttgctcgccggcttccattgcgacgtcgattctggccgacgtgtagcacccgtagaggccctggagctccagcatgcacctccacagctcccgggtgtcctccgccgtcaggccttcgcagcttctctcggaggcgtctgagatggatctgcggttcatcttttgcgagctctgggggtagcagtagatggatggtctggtggtggccgatgtggtggtggtggtggtggtgttggtgggatgatccgagtgtgtgaaagcggatgaggaggtttttgaagtatacgcgtgagcatcagtgacaagggtgtgctctgagctgcatgccgaatctgcggaagaggcggaggagcgacgggaattgtggtggaaatggtgatacatcatgtgtgatttgggaggatgtaagtgtaagcgggaggggggggttattgttgaaaaattttcgtgttaaaatttggcaaatttttctcttctctcgatgcaaatgttgagaggtatttggcaaattcgtcggaagaggcaatagagtgtgtttaggattgttttggcgtgggtttctgtcaatgcgatggttcggtagtgtagagttaatgaggcgatgggacaagggaacaagtagacagcgccgagaagccgctttcgaaggtcttatactggaattctcggtgaggcttagtggcaggggcaggaataattgctcgccctggaatttgctttttctgatcgggtcggcccctggctctggctcctttctttgcggccttagtctgtttgttgatgtggtttggcgattattacggcctcgacgatgcgctgtcttattactacgaggtgggtcgtttatgggcaatgcttcacggagatgcgaaacgaaaccaggccactccctgtcgtattgaagagacggtgactggagctcgcagaaacgtggagccaatcagggccttggctggcggtcgtcatcaaatatcaaggacccaacgagcggttcgatgaatgcccaacgagcacggacggacaagagcgagcgcttgggatgaataggagcagctggctgatgtttattgaaactcgctgagacggggcggggactgggacaggaggcggccaaagcagccaagcaagaactaatagtttgaagaggtatgtatggatgtatgtaggcgtttgcagcttgtgaaatatgagatgtgagatggccacttattatgcacaaggagcgggctgggtccaccctccatttgtatgccgatggatgggatgggatggatggatggacggcattggcattcgacatactgtacatacatggcacgaagattagactgtgccgaacaggcgggcagtccaggcctggccagaccgtcatatcgcagggcggcagaggcagcagtcacatgcggttggatagggttggattggccgcagatgattgcattgcgcatcctcgagcaggtatggtgcactatctggccccctctcgccccctcttgtggcgtgaatcagaaggcgtctacatttccttggcctctcgctggtgggtggcagctagtaattggcagtggctgtggctggcttggagccatcaccgtgcataaccttaacacaggaatgcttgcgtctggaccggggagagggaagagggagggcttcacaggtgacgcaccagacggcacttaacatggctgataaggctgggcgttggattgggcaggcagctagccgggatatgatcctgcaagccaggcgatcaatgcatggaaaatagctggttggatttcctggaacccaacgaacatgggggttggttctgtttcgtgcgtccaagcgccctgtctcgacgtaatcactcaatgctttgctcgatcgagagttctgtgcaatcatccagaggatcgaggagccggaacggcaggaaacaacaagatgaaacgcacagggggctgcagcacgacgacggctatgcccgatgacaacaggtgggaccccattcctgcttgtcgtcacttgcacgatggacgaatctagcgagcggcgcgcaaacaagaggcaaggagataggtagaggctgaacatacagctggaggatgataaggaggttaaacgcctctatctctggccttgctcttgaatcgaatgaccaccagattgcgtggcttaagccactagtcggccaaacgacgctgatcagggtcagcagaccaatcgtggtgatttgggtttgcgcaaccaccaaccttatcagcatcgtgcatgcggaaacgctcttggcgggtggtcgcgtgtggtcatcggggcagtgcagctgcgcatctgtgctcatggcaagcttggccaggagggcgagcggggatgaacagtgtgaatgggctgatgggtggtgatggcctcctcctgatcatgatggtggcctccaagcgaggattaagctcagcgtggtggtgtatagcaagcaggactaagaggcttgttcgctggtcatctgcccccctgttcgccttccctctgtccaatgccagccagccttgttcagctctttctcttggccaacttggtggaatgctcgagacttcagatatgagctaccctatacacgtagctcaacacataccaacaccacctcctacactttctcccatcgtaatgttgggccagactatcccaatcacagaaaagtcttgaggcctgtggaatgctgggccgtgctatggcccctgagtgtgatcgacagggcaagacaatgcaatcaaggttcatgcgcgatatgacgcctttcatcaggttccgtctttcccttacttcccaattactcggtgagaaaggatttttacgatgcaaaaacacctcattcgcctttgcttccggcaaaaaactgtagatccagctgttgtttcggcatttagggctcgtggtcatgctattcgacagacatttgcttgaccgcttcctgctcggaacgggcggacgaaaacagggcgatactttacgcatcacacgatatcgcattggagtggtccggcaatgacggacgcaacctcgacacgcttcatacgatgtatcattgaagtatcttatccaagaatcggatcgcgtggaagtgcgatgggagaactccctaggcagcttgttttcgcccgagttattctcttggggttcacgcatccctcggccccgtcactacagcttcacctcgcctgcaccgaggggataaccatgtgaatgccgagaggctgttccacttggacaatgatcggcagccggatcagactcaatctttaatgtgtcgactcggtgctggcccttaccgaggacaagcgacagctttcccttcactcaccgacagaaactcgggcaattgattttccattgtgttcgcaagtttcggttccagtcggctgcaacctcattgtctatttcgaagtctgttgagacggagaaactagcagacctaaggagacggcccgaaggacgcttgcggctggatacgataaaaaaacaggcccgccccggagagagacctagctacccgcgtctcaacataaatgaaaaagttttcctcagctttgaatttgccaggaaaatatcccaataccttcaagcgaagcttgctcctgcagttctggtcgtgcttcgccggatccgtcatggctgccgtgccgcttcaattttcgcacggaacgcgggcgacatgagaaaagaggcaccagaatacttggttttgttgtctctcttttcccacagggaattaatatacatgagtaagacgttgaactagcccatcaatcacttattttaatacagatcccaaccagcctgagcagatttccctgtagatgtcgacggaactgttgctctggatattttgtcataattgtcgggcaccggtccgatgggggcatggttcgggaagttggcatttccgggcgtgagacgggctaatatgtcttccttagagtcaataaagagcgtctttaccattccgcggtagcttggaaacacatccgtggtcgaactaggcactgaacctaatcgaagaagttgagaaactcggttgccatgttgtccatgttttcatggccctcttcaagcttctgcttcagctctatgatggtcgagcccttacgtgcgtattgcactgcagacctgcgtgtgacgccgctgctttgtacattagtgcttggccaatgtccgagagaaagctatattcaatttagaaaccatatcaattactttcttgcacccaacctattacatatacccatcctacgcgacctgccctgtccaggcctcctcattcgttgtcttgaacaaatttgataacttggtcataaaaccctagcttcccaacgctggtatatgcgccataagagtatgccagtgcttggcacctagcacttccaaggcaatctgagagtaggcaatcttcagtctcaaaggatttaaccatgtcgacataatctcgccgctcacgccatacgtccttggtgccttcatcgagcggctccccgttttgatcatagtttttaggcaaatcaaaactggcaggcagtgtctgtataaattcaggaaaggcaacaagctcccaaggaacagcacatgctccctcccagtcgataatcccagtgacatcgaaatttgtctcgtcgaccaggatattgctgtgcaggaagtcatcgtgatcgagaggaaaaggtccgttgtcgtgtgtagaaatccgggcagccatggctttgatctgctttggaaagttctcaacgatggcgaccattctctctgctggaattggaccacgctgcatcatgtttgtaatagcttctctgttccttttgaactggacgctattggcccaagcctcgaagaatgcggtcgctgtctcgaatggaccgccaatgcctggcaatgggcccatttcataccctccatcaccggtccgggtaatgatcccaatctttgggaagcgtaatgatgtgatctggacatggcatgctgccacggagcggtagaaatttgggcgatggcgtctaggaatcacgcctcggtgggcattatacccgcctagagcgtccatggcgacggtgccggggattagctccatgaggataaagggcacacccgccggacctttggggtctagatcatacgaaagaatccgtggtactggcaagctcgaatgttggctgatgtactgcattgttgccacctcgctctccaacttgatcctggttatatcggagtcggtgctcgagatgtggacgcgagctacccaacgagtgccgtctgagaattcgagcatgcggacgacattgttcatcccacaagctacactgtcaagcgctctgcatccctttgagttgtagtgtttggaggcaattcgacatatctcgtcccagtgtgctttctgaaaagcttctatcgccttggagctactgctttggaggaaatcgaggacggttgcccacgagcttgagcttgtcgccatgtcgggagaggggaagaccttgaatcggcagagcctatgcctgccaagagtatatttgctcaatatcgtcgaaatttgggctaaatcgtactggtggtcagatcattcagttgtcggaccaacagaccaacaagatggtcagttcatgagagcaacgttggtgcctaaaaatccgccctaattcaggtacggccacagctctccagtccccgtctcaagtgccccagcaataaaccaccaaaaagccatcaatcgtcacacctatctatctatctatctatctatctgcaaaggcaaggcaaggcgataccattaataggtatcaacttggctcatatcatatcagtgttgcaaaatgcctcagggctcatctagcgtttatacaagctgtgctaccgtgggatgcactgggaaggatatccagcgtggagagaggcttgtccgaaaagttgcggttgagttcgccccacggatgatgggcaataaatgggataacttggcatcctgtgtaatactaaaaggattaacttatcgtacgagcggtgaggggagaataatttgattttgatccagtggaagtcctgatgctacaacaaatgtgaaacaaaactcgtatgagccacactaaaccaaattactctaaagttaacacaagcaaggtgtccttatagcacagccatgcaacaaactccacgtggcgtatcccatcatggttttgacggctactattcttcatcgtatgttacctaataaagaatttggcttctttggctgacctcgataggcataagacaagcttccaagctgaggagagtgagtgcatcggtttagtgtgattcgttacgagcatccttaacagatgtcaatagaagacatgatggagctgaaggctaaacattcagtccatgtaagaggaagtataattggaaaattttcgattaatgaacgctacgattgagatgatgtgcctttccttcactctaattcattgcgccatggacgccctagttgcgccccttttcatcaacacctgaatcttgaccttttttcccattttcattttcctggccttccccctggccgtctttgtcgttctttccctcgttctggctctggctctgggtttcctggccaccgtcctgatactcctcctctggttctatataaggcacctcgtagtccccatcaaagtcagccccccgcttgtaccacgggaacagggcccggagcttcttcagcttgcccatgcgggcggtcgagtcgtagcactcgggcctgtccttccagccgtcgaagatggacaggaagccgttgacgtgggacttgcagccggctttcaccttctcctcgaggtcgttgggcaggccggtcctgtgccccgtggggtcgacgtggttgccctcgagcgagcagatggtgccgccgcggacgccgcggccgtagtacttgccccagtccttgataacgcgcttccccggctttcccggcccgcactcggcgtcgatgtcgtccatggcctgcatgaactcgaggaggctgccggtgttgacgccggtggggttgcatatgtagacgacggagtcgccgtagagggcgtagcggacggcgtttttggggatgaagaactggggcgcgtcgaagaggaggctgatggcggcgtggtagtcggacgtgggcgggacccagtccggcttgtggcagaagatgcggcccgaggggatgggcgtcttctccgtgagcgcgaactctcctctggtgaggaggcttgccgtggacgagttggtggcctgggacgagttgatgggttgggatgaattgatgaattggaacggtttgatggctttgggtggtttaatggcctgggacaagttggagccattggctgggaatattgcatggatctcatacggggggattccggcggcctgggcgagggccgatgtggataggaggagggttgtcagcttcatcttgcgtattgttgcgctggctaattgtgtgtttttcttctttttcccctccttctttttcccaactggatcacttggtgtaggtatgcaaagtgctggatgacttgtgaagagatcaagggagagaatatgtatggaactggaactcatggcaaacgcgatgtattaatagttggatcgtgaaagttttgttagtctactggaaaataaactcagagtctcgtattgagaggctgaaactgtcgaagttgtttaccaaatgaaattccttctaagttcacaaagctgcaggctagaattcaggaacttgccaccagaattcgggaagctgtaggctaaatggtcacacgtctcgaagcttaggaatagacttcaggctgtgagaagaaatacagaagagttgatacgactgctgaaactcagaaacacccttcaagccgcagaagagggaaacgaatgccacgattcttgaattcaggctgtgagaagaagaattttattatgttacggctgctgaagctcagaaacaatacgccagactgcaggagagcggaaaaaatgccacagttcttgaagcttgggaataggattcaacccgcgagcaaactttgccaggcacatactccccccacgataataacttttattatctgggcgcatctggctgtggatctagttgcccgtgggaacgacgaaacatgaatggcttgttacacaatctcgccgacttatccacctccggtacttgccaatgagatcacttgaccgcttggcaggcatgggcacgaggcgtcgtcggattcgagtcttgtgacttaagttagtaggtagcattagatcttaggaaacggcccggcgagatgataaggacatagttggacttccgccagttggccgggatgagtgaggcagggcgaggcggcgaggagaagaggcggaaacagcttgtggttgaagatgatgagtcccgttgttggatatctcgctgaagctgttctgctcgcccggaatacttgatttgcatggcgctaaatttaagtatgatgtaccaccatttgcccccatgtcggcgatgttacgcagaggcagatcactggggtcctgaggagttgcagatcatctgtcaggtctgcgcttggaaatgagctgcgtggaacagaaacgctcattgcccttgcggtaacgtcgtatttccagggtctatctatatttcttttcagtattccgccagttcgttcagtcacggattgagtttagggttaagagggcaaatatgtattaccgcacaaaccatatatattggaaactcacaattatatatcagcacttgagtacaatacattttatctaattcattaacgagacatatatgatcaatacagggattcggcatgtacattgggtagtctcggaaggcttgtgggagaattcgggtcttcaacccgagtcatccgtgccaccatcccatcggggccggggctttgtcttctgcacaatgtcgtctgactggagcgtgatgaagcatgccatccataaggcgaagtaaagtcttggtagcagagtcttggatacaaaacctgcaaggtcagcgagagcgaggcgagacgggtactaagctgggcgtagccgagtatttgtggtatttcctcctgcaacggccatctccttcgggatgcctctttcatcaggaaggcggacactaaattggaccctgcgtctatcatttcccggggtgcatttcgtcatagcaccctttttctggcatggcgccgcatctgtgcgtccgacgcccgaagcccggtggacggcgacgggcgaggtgaagatgttgacagcgaggtagccttgaaggcagtcatggcatgaagcaagggaatcgggatgtcgagctgtattccgatacccatctgccgttgcctcccgcgcccttctcatgaatttacacattgcacgcccctcccgccgcgtcgaaagagtgacatcatgaagggcagcttggggccatcgtgcaagtatcaggtgcctgttgcagcaggctaattgcgaagacgagagcgaaggtttccgaaggggggagcagcagcctgtattgtgcccggattgcggtagcacatggcgagtaggttaaaggtaatagagcgagcgctaggagcttacgcagcggccgtttgcttgtactgcagcagggcagcgaggccactaacagccctacgaattactgatcaccaggtctctgtgctgcgtcagcagatgggcgcctcttccaggtgctggtgcagcggacgtaaccttggcctggatgggcccatggatggaaatagatctctgcatcatgattagatcaattggaagaggcggtgtcattgattacatgtgtttacaaatggccagtcccagctgtggcggagctggacgtcgccgaactgagagcggcgacatgcgtcatcagctgagtgagagtcagaggataaggttgcttccagttttccagctccccaggcagcgctctcgccgccgaaatgcctgcacctcacataccgaatgtggaagacgcagcggtgttggagaaggtggcacgcaatacgattatgcactgcctgcgaaacaccggatcgaggcaataaatgataatattcctcgcctggggtggccggacagatggaatctactaccggagatgcattcagctgcttgcttgctcctgtcatgatggattcgtccagactcagcttcgtccccgagcgcacatgttagccgtccaggcagcccggcacgccgatgcaaggatctcctcaccccgtccgaggtaaggaggacgagagggcggctacgatggattgttacctgcccacatattttgcctcgaccccgcgatgccaagggacgagctccgcaagatgaggggcagcattgtgatttgcatgatggagatcctgatgggatgggccagtctgccattttccttccctatccagcctgatgccccccgtaagtctctcgtgtaccggtaccaggcaatccatccgaccttatcttctgcagcgagagagccgcgtccccaacagcctggtacaggggctgcctgctttgactgccctcttggcttgcctgtatgcttgcttgtcttccaggcctccgttcctcatttgacatacggcattattgaacggatagtctggtccttttgcgccggctggcctgtcttacccacacactctccaaggaccacggcacgcgggttgcgggaaatgagtgaaatcaaacagcatcgaaaaacaaggtctcacagcagcttctgtctctgacagctgccatgccagcagctgtgggggtctagactgaacccgctgatgagtccagatgacaatagccagagcgccggactcgcacgcccctccagagattggagctagacggtcttactttgctctctacctccattccaaccatcgtgcaatttttcactattgctcacagtccaccaatgcgaggccagattcgcttcccggctccgggttattccacgcacagatggatcttggggctgggccatgcacgcggctcttcttctagcctcccagcccggcccagagctccctcctcctatgccatgcattggagctcgctcggcatgtattcctgcttgcgctcgccgaacgtcagcttacccacgcgacggtggctgcgggtttcgccgtcgcggccgcccgcctcttctacgtcggccgggcactggaatgttgcgtgccttgggacgtacccaggacgaggtaaaacgacttgactgccgcccccgtaggtgtgacaggctgatcacagtgataatcatattatcataattatgctgctgcccatcgcatcagcgggccttggcggtgtgtgttcgttgcgcgtgttgcgcgaaagctgtaagtgtctggacgcatgtgattgacgcctcgagacgtgacggccgatcggcgtcgaaatcatgggaatctgccaaagcccgactgcgagtgcggcagcaacctacatcttactcgagatgtcgatccggcggatgacccatctcattgggagaaacgggattccctcctgtcgagtctagccgagtacactgatcccccccctcccacagccggtcgcttggaaccaagcttaggaaccgagctgcgtggctgacggccgtagagacaccgagataggcaagttttccacacgagagatgcacattcctatgtcattcaatccggtatcgagctagcttcatgtcatgatgaacggcgcctgatggttgcttgatgacagcgatggaggtgcattcaatgggtggtcatttaatagcatgtgcaataataacagctgggctggaacacaaaaataagagtcagacagatggtcgcagagccgctggtgaggtgtgatgggctccagccacgattgggcttcttgtgatgactattatcctactcggattcgacagtttcttgcatattttaggtgctatgggttttggcacagcaaaaatggagtggctggctggtgagagctcacacacgccccctccagatcatcaaatccctccaccccccttttcgacagcgcggccactagcttccactcgtacgagtaccggccttctcaatcggctcatttaatcactatcgtaccgctacacgaaaattaaggatttcgtgtctatcgcagtcgtagcccaaccgtcagcttcccctttcagggtccgcccttttgggagtttctctgggacttctgctctgggccagatgcttctattgctgacagcaagccaagtcaggctgatatcaactatcgaggaggcgcgggctgataacccagacgcgatgcgtgcatgggcctggctgtgtctttgcctgcctgctaggctactaccttaaaaacactatcccgttcctttcgtcccactctggtcgatagtctgtccgcgttcgtattattatcgacacagctgagcgagcacacaaatgccacaccgcagctgaagtctcggaggctgcctgaaggtgcctgaagtgacaattgggaaattacaaatgtgacacctgtgctgggctcaactaggtaggtatgcaagcaggaaggttagctggatccgggagggccttgggttgctggttggctgaggttcaagatgcagggctgcccattgaggacagagttctggtgctgtgatggctgggccaaaaaggcggccgacagatatccgatggatggatccttgtgacagacgcgggaccgcatggcatcgcgatccgtcgcgaatttggcgattctccgtcgctgctacacatgcgtaggggtatatctgctcggtctaattaatagcctacgtgccatatccatgactcttgctgtttgttgcagttgccgcgggttcctctgtgatgcgatgcctgagtcaagcacgtagcagatacaagcgctatacggtgccaacacgggtcatgataggtacgcgggagcaataacccacctgcgggcccccggtccctgtccgacgatggagaagctccaactccccaaaggacggccaaacagatggccaggccacgagcgatttcctcgtgctctgcgccctactggtacgtgacatctggctgggcacgtttgtagcacatccaaaagcccgcagtggtggtatgcttttctcgtcagcctactgcgcagttggacgatgtgaagatggcatgacgtgttgcgaggcggagcgggcggatgtgttctgcacagaagcgacgagaaaagcggaagatctcgttcgaaagggccgcggtcgattctggatgcgagatggtctcgtctaatgaacaagcacgcatccaggccacgcgagggaaacgaaggggcctgggaggcgagccatacagcggcctcagatcggtcgcgccggcgttccgcccgtctagattgcagatagacagcaggcaggtacccatcacatccacaggcgcctcgcaggcgggttacaggcgggtaccccctacctgggtatgattacagggcacgctgcagcggtgtcagcgctgcactacgctgcagactgaggcaagggaccggcctagggacacgccccctccactggctctgggcctcccagtggcctcttggaccgcccatctgcgtcaaagcccccggtcatccccagcttttttgccctcagtacctcagctttgtctcggtacaagcccaaggcagcagacggcctaccagtttggattttccccataaatctacgttgcgtggaccccagcccacggcccagggtgaatccggacacattcaaaagccgaagcaatcctcttcttctcttactcgccttgccacgccgtctcttcctcttcataattctcaaccatctcaccgtcgaactcgaccataatatactgggtctcatatacatagtcgaccctgatccacaatcacacgacaaacagtaacaacgcctggggctgttttttttttttttttttgctttggataccatcaccaccccttttaaccgccaacccctagttgacagcctgtttttttttccgcccagcgcgtacctacaggcgacctcgctgctgcattaccccttcctcccccacaccaccaccgagctctttttggggtaacacctaccagcgcgtcaacacaacatcaacatcaacattcaatcccatccaatccatctagcgcatccaaccgcgacgcgctaccaatcgaccactgctttattcatccaacctctccggctcggaccccacacatattcaaccaccatgtcgtcgtcacctgaaaccgcctactacctggtccctaatttgcaggcgctggatccatcagcacgcgaactcgatgcaagctcaacgacgtgggtgcagcccaccatcatcgaggatgaggacctgacgtttggcggcaagagcctgagcgcctggtacgaggaggaccgcaggcggtttagccacagcgacgaggaggaggagcgcaggggccgcgagcgggtcaggagacaataccccgagaagaagcatgggaagaactaagacaatcgacacaagaatgtcgattggtacatgagacgggaaactggcggagacgccgccgtcaagctacagcatcatatttggatacaacgacagcaacaacaccatcatgatacccatccccatcaagagcgtgccattttttttatagacacgctgggattcgatcctcttggacacagacgtcccgaggtgtttcttggcctttctggcaaaggccagtacgacgaggaattttcttggaagcaacatcatatcgcatcattctgacggcagaagtgaggtccggcgagactcctgagccttcatacatctctatacatatatatccacggcgggctgccagcatgtaggaagacatgctggctggatcgagaaacctggacaataccgacttgcattttagactttcacgcatctttggattttgaaactgcgcatacacacacatcacatcacgacacggcgttttctgtttattacacaaggttgatacacgatcggggggcacgcactccactcctgcgtgcctgctgttggctctttgcatttgtttttgcttctatttgcgcggggatgtgttgtgtctcacactgacaacatccatccccttttcatgacctggcgcatcatcagggcataggtactctggttgatatttcttgtttaaccctccaccaccataattgcatgcatggctaggagccgggattgtgaccgggggccatctcgctcgaggcgaggaagagcccggagctactgggcagtgggattagatagctccaactgaatggcaggaataccataaaacattttctccccaaactgttgttctctcaaaggaaaccgatgacgtgcatgcctgcaacttgtagtgatgatgggtgcttcttccctagccacaggggcacagcgggccttggcatggcctcggcattcctctgcccaggccggccatctcatcatacatactacagatgttccttatcaagatcgagtaagagagtcgtggagttgccgggcgcagggggcggagctctctcgcccactagttgcggcaagtaaacacgatgcggcaggaaacaccaaaacagggcccatcatgatgtcatcaccccaacatacgccctcttttttccctttgctttttcttctctacttcttggaacggactccattcggatggtagatgacgatgccccgctgcaagaatgaaactcaatgtcctcatggcaattcgcccagtcgagatcatgggaatgtccatatgggagggatgggctttcttctgcgtgtgtggcgattacgatgatgcgatgttacacgaacagcggcaaaacacacctgattacgttacgccattgcatcgtttgggggtggctgctcactcatcattccgccagggcagtggtctcagtcagcgctttaaaaaaattccccagggcaattggctcagcgaaaagaacctttacattgccgggaactgtggcgtggggcgagagaacggcaccgagaacgggggaaggagcggcaaccgaaatcgctgcagcgacgaaacataagacgtcatcggtgactctcccagcgatccggattcccagatgaggggatctgcatctggatttttttcactcccctcggggatttcggccgggagccttgttttttttttgtcttttttttcccggttgggattcgaatcttaaaatctcgcttgtatggcattttctcacgcccccctttcttttgtggttagtcttgacgagacccgggacatggcctgagaacgcgtggcgactctgtcaacgatcgtgatctggccaacggtgatgttttatatgtgcctgcttgtatagatactttggagaacggggctggcgtaactctcgagggtgggcagtcggtgccggtttgtatccccccttggtttcgtgctcactttcccatggtaaatgtgcatttggttgctagcgcacgtctgatggtatttttgatcaagactaccttcacgtgggaagtgtaacgttcctgcatgcattcttcacgtgaagcgatgttgtttattggtgctgaatttgcctggctggaaatatctcctggttaacgctcttcgggctgctagtgcttaagaggtcacataactggcaagctgtctcgcattgtgcgtctcgtttggatacaacctcgtacatttcgggctgcttcaattgttgtgtgctgctctaggcttttacttcccagatacatggtccattgctgtttctcttgagtggcgtttggttgagttgaccaagacttctcatcatggcatgcatcatattctgcactttgaaaggtcatggccagagggagtgactgaagctagatgccctcttaaacgcacacacactctccttgcagtgatatcagaaattatgtttctaaattccaagttccagctttcttgtcgttcactgtttaagctagggggttgtagctagagttgataatattctagcaaccccggacatgttggcttattctctgatttttttttctttctaccgtgtactgtgtatgatttactattaggacttgaaactcagaccaatttatgaaaaaagatttttattccaccaaccctttcaactattcctacaccaaagaccactcgcgagggatttgattggttgagattgagaaaaggttgagagaaggataagttcaaacaggaacaagcaggagggacctgttgaaataaatagtagagatggctagttctgagagggcgggatattttcttccctcttcatcatcgcgatcataaaaagtaaaaccatctcaattcgtgcgtttctctgcattctctcccattgtgttatccatgttatatcaccacttgtttccaagacatcaccccggccttccaacccgtcgaccccaatgctcaatactatgctcagcagcctcatcccggcctgccacctgttcccggccagatgccatggacagtacaccgtcccagctcagcggccccaatactaaatctcaccattatacgtatctgaagcaaggatagactggggtcatcgtgacccgggaggaagtcgtgggaaactacgccgaactaactgcttgacaagctcaggaatattaacttctcggattcccaaggggaactaaacttgtctcataggggcacagcgaaaattcagcccagtacagatactgcaagggctgttatggggagcactagtgagacagccaatgtgatccatagcgatatgaccacttgatgccttcatgagaatgcacaatatgcacggctcgtgtacattctcaatagcggtggaatgcaaaattttcatctagggggggggaggtaagagtaacatccccagatcggtctggggaggaatggtatggttgctcataggatggagcttcactggatgaagcaagagtggttatagcctcatcatgaggctgtgtgtcgccattactggctatccccatgccatcatgaggctccgtgatgctgatagaagatgactcgacagatgaggagggagtgctcctcaaccggagcaggaggtactgaactgccagcatcagagggggctgccatctgtatcagagccagcaggctcccaggtgatgtggctatcctgaacgtgccatcggtccgatccgtgcccaattgaacaagctggacgcgccagttgctccatgcatcgatagcttcttgaccaaaaaggtcacccccggcctcgtcgcgatgcttctggagtggttgccacacggagaacctctccctggtgcagccgacatgcaccaacaatgcactctatgtgtctctgtcggaggtctcatgcaggggctgtctgctgaggatatgtaacatcaagcaataatagacaagtcaccaaatacaccgagacgccagagcaaaagatatcgtgggatgccttttattaattactttggcaatgcagaaactccatttctttatcaaccatacatgaatacaaacgcggcgcaaacagaaacactctggtatcttgtgaaaagcaatcccaaactcctgctatgatggtgcaaatctcaaacactcatgcattcatccatgctggccgcctcaaatcaaacattcttcccactcccaaactccaaaaaaaaaaaatttcaaacaaaaattcattacacgttatctttcgccgatcaattttggcttcgagtccgggcgcgggtcatccgcttggcgggggtgccattccccgccatgcccagactctgggccgccactttggaaatgcgaggcttctggggtgtcgccttgggctttgacaccccagcctcgccctgcgtggccttcttcttgccaagcgcgccggcaggacggccacgcttggtcttctcaccttggtgagactcgaggggcgttctccaggtgacgttcttagccttcttcctggttgacccatcgcttgctgagtcgttcgactcgccttcggaaagctcctccgagactctagccaggatttgctgtaccgattcggccttccccttgttcctcttggtgttcaaattcgtctggcgcgtgagctctgcttgctcatttcgcaccgccgagttcagctttccttgaacaggatcccgcccagcagtaggtcggccaagtttgatagacgtcgggatagaggacttcgtctcctgggtgttcagacggctcgagcgacgacatggtccttcttccgatgccacctccttcggttcctgcttacgaggactaggcacgttgtcttgcccaaccacggatttctgagcacttggctttgccttgcgctttggttgaggttcttccgacttctccttcgacaaattgcccaagcggcgaattcgcttcacagcaggctcctcggacttcttcgctggcgaatccccactgtcgccttcaacaccttgcttgcgcttcaactttttagggctgtcgtttccggcattagggctcttagcctccaacgggacacgggccggggaatgtgcgatgggtgagccagtctcggtagtagacaatcgcttgggcttcatatttctaataaaagcccgcatgtattctcgaccagggctatcaagattctgttctgtaatcttcttgcttgcgtgctcatttgtcatgggctgcttaggcgcaacaggttcttgggctccaatttgacaatcttccttagagggagttggcgcgcgcgttgaatgactgccgctcgttgacacagaattgcggggagagttcttgttgacgggagtgaacgatgtagccaatggtgtgcctcctgggcttgtcttcacctgggcttcggaagagatatcccggtcaggagaaacagatggtgtcttgacctttggttcagaaggagtattccggtgggaggaagccaatggttgcttggatggtgtcgccttggatagtgtcgccttacacggcgttgctttggaatctccaggtagagccggcgaaaagtcaatgttgacaaatgtaggagtctgaaacgacggctcaattgatagatcgctgatcagccctgagctcggggcctgcacgtcaagattctgacttggccgagcaggtgtcctgatttctgaagactggaagacaggtgaaacgcttgacctcaatggggttccatccatgtatggatccatgtcgaagtcgcctacgacaagcgtctggtcattcgagtcctcgttcgctggactgcttgggaattggactttcttaagaggtgaagatgttcccacaagattacctggagtgaatgcgctatccatgatgccaaggccggtacggcttatatgtttgtgcggtgagggcgtgggagtattgtttgatgatgtcttgtcaacagcctgatggatatttctcgaaatttcagcggcgttgtgtggagaagaaactgattccaaatgcggcccatcagcaacttggctctgaggaaatagagaggcatatttggtcggcaacttaaaccgaacaacaagctttccgctagactgggtaaccacaacattggcatacccgtcgcagctttctccagccaagtctgccagcttctctactgcaggggcaataacaactcgagaattaaagatgtcgggattctgccgcatgtcgatgctataaattccgttgcgatccgaccgtgttccggctggtcgtacaactgacaagggctgcctttcaaggaagtactttgagaatggtgtgatcggtccggcgctgccaactctcgatgacgctgttagagactcgtttccaggttcttgctgatgtgtaggtgttgatacatccgtttcgtgagaagcgggcagagcagtctgggtctcgaatatttgcagagctgggcttgcttgagtgacatcatcgtgatcgtctgtaagagatgataggacttgatgcatatctgattggcggcgcgaggccccaagcttcttcaaatgcctattcaggataggctcactctttcgccttcggctcttattcacattctgagttcgggttgcttccttagactcagacgcatcgtttcgaagccagtcgattctggggctcatttgtatgtcactgatttctccaaaatcaaacatctccggattgctctcccaagtcggaggaacgccatcaaggttgggagtagaaggacagatagaatcaacaatgcccagaggtctgagcggagtagttctatgttgcgtggtgggcgtgccaaacttaggggtggcaagtggagatcgagaccagcgagaaggcgtgggtgctccaggacgtttggtaggggacgggacatgctggggtgtcatagggctcgatgtgccaacttccttaatggtggtgggttcaggatatagcgatggcttgaagcccttggctggcccatgtggaggaaggttcatggcgagttgtggaagcttcggttccaaagtgatattctcattcaagctgatggcagatgacacagccggagcatctctaggtggtgatgtctgagacttgataggcgatgtcagaatcgaggctggcgtaataccagggtttagtttaaccaatgtcgaacccaagccaaggttggtacgactatagttgtcaagtctagccttgcgcttggcgggtgaggttgcggcagctgacgctggttggggcatgggccgtggttgcgaaatctcgaattcggattcatcgtcggcaattattgaaagatctgggacgccacacgcagctggataggtacggatatcccgatattcctcttcgtccgactgttgagggaggaggccaagatctgcccaagactctctcagcgcgctcatgtgttcgagatgcatcttccatccttggccaccagtaaccgtctctccatcgatgttgcgcttgatgcctcggcagttggcgggtcgcgtatatcggttgtcgtggaacttgtttaaagtagggtgattcgaaatgtgcgagatcacgtccgcttccgaaatgttagtaaaatccaaataccatgcagggaaggctacggcttactctttgcttggttgaaaattaactctgtagccataggcggaatttcttggaaggacacctcccccgacaccaatttatcatccagcttgcgtcttcgcgcagaacggtcactgtcctgttcctcggtagcatcactcgtggcaggggcgatcagaggttgagcgcgagggcgacagggaatgccgaccctcttcatcattgttttcaaggagcagtgcgcgcgtgaagatggtgcggttgcgacgcgacaccaggcaggcaatcggttctggggaatttgtacagaaaggcgggaagcccagttgctaacagaggcatgtcagtgaacggaggactataatatgatcgagagtagacaatgtttacctagtcactagctggccgccagagccattatgtggttggggtggcaccaggcttgttgggtatcccttcatgggaaaatatgtcacgaatgacgggggaagtgggtttctactggtgtgttaggacgcgtctcagaactgacgaccaagacaatgaatatctcacaattccactgatacgagtccgtccaggggacttgattcggagcgagaaagggccatgttcatggtgggcatatcgcctgggacggaacgctgctcgcgtggtgagagcaccatcgcgagagtgacccaagtaggtgggatgggaaggccgaagcagcagcaagctcaaaaacactcgaacaggagggtgggaaatgtgtcggtgaaaattcaaccgtacgccggaatgcgaaaaggaagtatcgtcgacggcaagaccgtgaagttataaaaagaaggaatgcaaaatgcagaagaagcttgggaaatgaaactatcatctgcctgcttgaagaaccgactttccctttgtttacatgcccaccgaatttagatggggtgtggtggggccatgctagatcaggactagcggcttggccgtctgcagatgcacgccgccaaacggctgctggccactcaaaaatcacccctggacccttaatggacaccgcccaggttaatcgcgacgacgtgactgtcgtgattgccgtcgcgtgtaccacttatgcctcgtcccacggggggacctcaaacatgttcccgctggaaaatgcacgcatgccgcgctgcaccgtgttcgacacacatttacgcgtccgcgcagtttggcttggcttggtttctctctcgtcggtcttacaagacggtattacatgcaagtcttgccaaactcaaagactcagcttgccttttacaattgagccagcaatcatgatatatcaaccgggaaatgtgacatgattaggcaattactagttctgatgcaaactaatcacccgtacatccatgttctctcagtatgtaccaaaatctaggtaccaggtaggcaagtaggtacctacacaaaccatgagcagtcagactgtgttaggtggtgataagcataaagtgctggctgactcatccatacagcctccgtagctttagggtaggtgctttttgtcgaagcccagagaggcacgaggcaaattgccgcagtgaggctcgtctaccttaactatatgggatttggcacatctatctggttgggtggcgagccggccaatacggaaaagaaatcgaggttgtcttgatttaaaaattctgcggtactaagaccgaagggggacaagtcaaaagtagatgccgtcgacatgttcatgagtccatttaattgcgagtcggactcatctgaaccgagtatattggaccagctatcctgcagtggagggctcatcaggcctgggacttgagatatcagctacgtctgccgaaaacatggatgggtgagactaaccggttactgccgttgtccgcacgagaactgctaaaaacttgcaacacctcctggagagcctcgcgccattcccaagtttccggagagcttgtgcagccagttgtaggctggcacggaggtctgtggtgcggatatcactctgagacagccatgacttgtcggtggcatgaatgagcagtgccgagaagataatcagtgctgcgttaaaagctagaaaataggttcgttagactagcgagtctaaaagagaatccatgctcactgtaataggtggaaaaccaccaagctccgagcgtcgacggcgtatcactgaggttgtgggcgatggtgatgatctccgaggcggattcaatgcacgcctcgagatatggctgcccaaagcactgcatccacaacatctcattttggtctggaccatgaactcgcagctgctccatatacctcgcgaggaccggccgatggagtagagtgcggatgttgagatacctcagcttgagaatgacagacaatttgtcaaaaacaacgtcagctccagagtcccctgagttcacatcccacggccttcggctaagagtgtcaggcaggccgcgtttccacgcgagaagctggccctccaatctgattgtattttccaacaagcacgatagggaggtatgggtcgaagttccaatgttctggtcgtactgatttgcaatgatatcgccaagaacttggtacaaggtgctattgcatgttaatatatatataatttaacggcgtttccgaattcctcacatggtggcaacaaagaacgcggctgtaggagtaccacctccatcttcaggctggagtccgtccccagacatcaatgacccaagatcaacgcttacgggcaactccatccggacgtattgggtcggaatagccgggggccgcccaaaggtcatgctcattgtcctatgcaaggtttagtgccgacgtgacaaagcgatggtgctacgggggggggactgacctatccaaaatgatgcatccgtaccaagtacgcttccggacctctctctcgacagcattgaacccagacgaagcattctcaacatggagccccagttgcagcgcagctttgactgtcaacccgtgaacattccacgtctgggccgagcgctgtgtaccctgcaggtactgggtcatcagaagcaaatactggactgcacaactccttagcaagtacgggaatcgggaagagggcaggttgttcttaccaatctctatgttgacattcttgaaggtcaagtttccagagagtttctgagcccgcttgaagtagacatttgagtcggccgcgctttgttccacgggctggttaggttgggtactgatgcaggtcacgaacgccaatatcatattgagcaggcacaaccacgagcgtcgagccgagccgaagccgcctctcttcacagctttgactccgtcgagtactgactgctcgtgaatgtatgggaacaacatgcctgtgtccctgaaaaacaagcttacgagatggagcgtgtctgcctctgggggcaagatgtacacatcgacaatgtctggtgcgccgttgaagacctgggggttagttacgggcgatgcaggtctggaaacgcgtagcagctcgccgttgactcggctctcggaagggaggacgtggtcttctggtcctgggcctggggcaacagaagatgctgcagcaactgcaccggcaatctgctttataaaggccacggtggacgacggccctagacaacccaaacaatcatcaacaccatactactagcagagaagaattcggactctaggtcaaacactaaccaaagaagccagactcttgctcgtccgcaaattttatggcccccatgccgtcaacagtatcatcttctgggatattggcgacggaatttccgtaatgagacgcagccgctacgtctccttcctgagcctgggaagttgcatatgtaccgcactgggagtcaatggacgaaaattcagccgctcccgaggcagtttgttgtctgttcctctgccggttctcctccaaaagaagctgcagcgtttgctctatggaggtcagtctagcctcgtgcccatcagacactctgagttagacacgtgaaaagttagtaggaaatcgaaatctgattacagcacgccagaaagggaaaaaatgactttatgagagggtaggattgttaggactgaaaatgccatactctttgcgtcggtatcctggctgttggtaaacgcaatccaggcccatctccacgcacatggcacattgtgggcgtgtgccgttgcactatcatgtcaattagctgcttgaagccataccggaggtcaagtttcaatcagatacccgtgatttgcgattcctgtaacccatacatggtcagtgatatggcatgggagctgcggcagggggggcccatggccccactagaactcaggacagagtagagcagtctgtctaactgctcgaatcataccgacaactgttacaagccagagcagttctctgacgtttgaatgacggctgcgaatagcccgagtcatccatgccggcgagccgccgcgggtctgaacgggagctgttgtcactggccatgattccgtgggcttccaaatctagtcgccccggatattcgggtctgtattgagtactgatttggtatagtaatgatttaaggcgtcggggaagattggcagcttcagtgtgtcacgaatgagcggtgcgtcccagccgatatatccccctccccggagataagagcatgccgtcaacataaccttaagccgacccccgcatacctaataataagaaatccggggaaatcacggcagcgagtagcgaaaagcgagtagcgagtagcgagaagcaacatggaatccaagtcaccacgattccggtggggctgtatatcaccgttggatcgttgtgccatccattaagatggataaaagcacaagaaaagacggctcacgatcctacttgctgatacctgaactaccacaaaacgctctgccgtctagctcgtgccaacttgacatcaatcttggtcatcatgcctgttttagatccttcaagtgtcttgcctgagaggttggacctgttctacggcggaacgtggcatccagtccaagatggagaatatcgacccgtcttcagtcccgggaacggccgttcgatcgccagtgtggccttcgcaggccgtcaagacactatagccgccatcgaggccgctcacgccgccttccccaagtggcgagctgttccagctcttgaaaggggtagaattctgcgcaaggtggctcagaaggtccgtgataacgccagcgatctggcgctgctagacgccttcaactcgggcaatcccgtctccatcatgacacaggatgcccattcggcagccgaccacattgatttcttcgcgggcctgatccccgccgtccaaggggagacgacacatctggacgattcggcgctcaactacacggttcgggagccactcggtgtcgtggcccgtatcatcgcctccaaccacccgctcatgtttgccgctattcgccttgcggctccgctggccatgggcaacacggtcgtcctcaagaccccggagcaagctcccctttccgccctccgtctggcagagatcatcggtgacgagttcccgcctggcgttctcaatatcctatccggcggagtggagtgcgggcaggttctctcaacccactcgctcgtcagcaaagtcaccctgaccgggagtgtgcccacgggcaaggcgatccagaaggccgccgccgacagcttgaagctgacgacgttcgagctgggaggcaagaatgctttgatcgccttccccgacgcggacatcgatgccctggtagatggaattgtgagaggcatgaactggggctggtgcggacagtcatgcgggtcgacctcgagagtcttcctgcacgaatcgatccacgacaaagtcctgcccgtcgtggcggagagagtagccaagctgtttaggcccggcaaccccgtcgacaccgatacgaccatgggcgccctcgtcagcaaggcgggccagcagcgggttctgggctacgtcgacattgctctgaaagaaggcgctcggttggtgatgggcggcaaaatccccgacacgcccgacactgaaggaggcttctttgtggagccaactatagtggcagatgtgaagcagagtatgcgcatcgccaacgaggaagtgtttggccccataatgtccgttctgtcgtggtccgacgaggaagcactcatcaaggacgtcaacgcggtggactacggcttgacaggatcagtcttcacctcagatatcaaaacgatgcagagagccgtgaggcagatccaggccggcaccgtttgggtaaacacaaccagcaagcactactttggaatgccatatggaggatacaagcagtccggtattgggagggaggattgcttcgaggaaatgcgggagatgacccagacgaaggctgtgcacgtcaagctttagtatctatagtttccgttgctcaaagtcaatgccacctacaaagatacctcactagatcatgctcatagtgaatctatctgcagcgcttcaaagtttcgatggtcacgaaaagacggcattaacgtatgtgatgttaaatcacataaaccgatcatactcacctcatcatcttatcacatcggctcaattgcccggcccagagcgcgaaacgttgtcgctgcaatactgtgtctcatgctagctcctgccaacagctccatcgttgtggccgtaaatccgtgagttcgctcccccaaggttgtgcattttactctctgctcgtttggaagaagtgattccatgaagggagaccgtagtgagcttaaatatataaccagagcgcattcgagtgtcttatggtgtctccttaaggctaaatctacactctgaagaagaagaagaaaaggaattctatccagccatcacttttcactacgaatttcggctgacatcagactgcaatcgtttcctgacaagatgatatactagattagaggcgtatccaggttttgccaacggtggctggcctttaagctgatgatgatttggacgcttccatgattttagttctaatattaatgtagtctagaattccaacggcgaagagatgttagactgcaaggacaaggttgattaatgctctattcgattcgtcccccggtaagactagcagactaggccagatttgatctgatctaggctctccatcttgagcttccccgtggggaatacatcccatccgcatatccccccggaggcacgaccgtctgttacccgatagtcggggaacgcccggcacactgacaatagatggcaatagcctccttgctcgctgattcgtagcctgggcgccgtgagtacttagctaaggcaatttaacttcgtatacttatgagctgtttcaaccttctcaacccctagataaatctggtccatacttaattgttgtcccaaatttttactttgcagaacgaccaaagacacccaccataatggatggaaaaatccccgaagtcagcaccgagtctgacaagcagcaggaaatccgagtcgagaacgcactgcggcctgagcatattgccacgcccaggtatgttgcatgctgtcgtctgcttgatcgtagccgctgctcctctatgcctttctcagctagagacggagagactgatgcattgatacaggcacgacgcagagcgcgaggctgccgagacacggctgcgtcacaagatcgatcgatatgtggctccaaacattgccataatctaccttctctgctttctggatcgcatcaacatcggtatggaagctattgacaggttgtcgtgaggtccactttgaccaaaactgaccttgaataggcaatgcgagaatcagcactcttgaggaggatctcgacatgcacggctacgactacaacaagctcctcgccgtcttctatgtagcttacatcgttgcggaaatgccctgcacgtttgcttgcaagctcatcgggcccggctggttcttgccaggcgcaaccgccgccttcggcctgctgactctgtgcatggcctttgtccagagcctgggggcagcctatgccgtcagattcctcctcggaatcgccgaggctggagttctgcccggcatcgcctactatctttctcgctggtatcgacgaagcgagctcaccttccgcgtcgccgtgtgcatggtcatggcccccctctcaggagcattcggagggcttctcgcctctggacttctttcactggagtccgtcggcagcctgagaacatggcgaatcatctttcttgtcgagggtatcatcacctttgggttgggtgtcattgcctttttcaccatgactgacagccctcagtcggcgaaatggctcacggaagaggagagagagctggccatgactcgcctcaaggtagagcgccaggggactattgaactcgtcgacaagtggaacttgaagaagctgaaactcggtgttctctcgccctctacgctcaccacattcttcaactttctgttgattggcgtcatcgtccaaagcttcagcatcttcctccctaccatcgtcaggaccatttatcccaatgagtcaatcatcacgcaacagctccgttccgcgccaccttatatattaggtgctttcttcgccatatccttgccgtggttgagctctcgaatcgaccggagacaaatcttcctcattgcaggatctccttttatcattgccggctactcgatgttcctgggcacaaactcgtcgcagtccatggttcgctatgccgggacgttcctcatcgccatgggatccttcaaccaggggaccttcaacaacgcgcaagccgcggccaactgccggtcggattcgtctcgcaacgtcgccatcggactggccaacctcgggtccaatgtcggaggcctggtcgccacttggacgtatcttccttcgggcgcacccaacttttatctcggtaacggcatctgcgttgggtgtggctccgggattctcctcctgtccatcggcttgttgctctttatgaaatgggacaacgcgcgcagggagcgccgcgacgccgcggccgagctgagcggcctgtcagagcagagtattgacgatcttgaatggaaacatcctgaattccgatggaggccttgaggttttcctgctcttgggggagaagctactttgactcgtagaaagcacgaaggctagtcttgtaaatttggaacctatctatgtattcactaggggaggaatctcatcagctagttttatcaaggctaaataataatacttgtctctacacatattttgatcccttagaaccactgagcacttgatagggtggcgttgttctcgggtgccgcctccccacctcccccccaacgcatcgtttgccatggctccgaactgaatttgcgggcgggacgaattctatcgtggtaataacctgcgagaacaaaagggtccttccatgggtcaagtgcttacggcgctggtggatggcgtttcgcgtttgggggtaaatcggcttgtcgtcccggcttacaccagtccaaaagcctaatgcctgctctcatttccggcgcagaatgagtgagcgcttcatccttgtgtacttggattgctagacgatcagctccgaaatggccactcccctcaaacaggtgaggacaagctctcgacttgggggaccgctgacctgttagtgacctcaagctgaccgggtgcctacgatagattctaagcgatctcattgtcgcaaaccacatcatttactccaagggtgtggttgatgcgttcggccacatctcagtgcgccatccccatgatcatgatacattcatcatgtcggcaaacatggcacctgcgttggtgagctcggaagccgactttatgcactatcgtgtatccgatgggtccccggtgcaagaaacatcctcaaagcactttattgagcgattcatccactctgagatatacaagagatacaacgaggtcaactgcgtggtgcatagtcacgctgaagaggtgttgccgtacgccatcaccgacgtgaaacttcggccggtcttccacatgacaggatttctcggtacagccccgtgtttttgcccgtgactgcgtaagactttactgatgctggggggccgacaggcagagaaacaccaatctatgacattgaggctacttaccagaccggggagctgcacgatctgttggtaaaggatatccggcatggggccactttggcttcgtgtttctcaacccatgactcggcgtctggcagcgctactccttttcccaatcacaatgtcgtactcatgcgacgccacggcttcacagtgctcggcaggaacatcaaggaggctgtgtttcgggccgtcttcactctcaagaatgccagaatccagacagcctcccacatgctccaactcgcggctcaaccgagcaatgcaagtttgcaagaagctgtgaacgggctatcggtgcagcagattaccgatagctcggctacgacacagggtgtatatgatagaccgtgggatctttgggtggtggaaactcgcgcacagggtttgtttaagaataagatgctcggataggaccgcggtcgaggctgggtcgcagtggattaactaagggaggcttcggacctgtccgacctgtcttccgtcaagacgagctagcttcgcttaccttaggactgcttcgcaggcattgatttgtagacactcaatgagaagccaagcaacaatgtttcactccgcaccctccaactaatttgcacacgctgggcatcaacaaacggcccatcgggttaacttccaaactattcctacctcgataaaaaacttcaatcgccgatgggacactggaacagcgagaaattcgatattttgactcatagtacaggtccgctatcaagagtatagacaaatattcaactcacatggtaagatgcaggtacagttggacatgtggaatacatgtacggtggactactattcaggcttcagagccagtaataacctttccagcgcggaggaggtagggcttgatctcttcatacttccaggcatgggggatgacggttgggttggagccggggggttgagcttgttcatctatgaccacaagggtaaggtgtgcgttgactagagctccgagagcagttccttagtttgttcttctctactttctgcctgcgtagccatcttattcatgattggtaatgagcatggaatcttggggtagcgtttgtgggctgtttcttgctcgatacgttagcctgctggcgtgtgaaaaggccttggcctcaacatagccctttataatgttcttaaacaaggctctaacgatataataatctctgtttcctacagtattctgggcttgggcgtcacggacggcccgatataccccccgaggcttccttatagtacctcgggggtaaatcggaaaagtctcataactaacaaaatagttgtcatcccgagcgacacagagtagccagctttaattaagggcaaaaatatctcgcttttaagctatcaagctctcgccatctatcggatagtaagctaataccttgcatattcttttctccattactgagaataagacaagattcaaagatggctctcagcgcacttccggccatcacttcctcgcgaatcgagcccgagccgcgaaagggctctactcccgccatagtcacctcgatcaaagtaagttaccatggtgcatgcagagctctcattgctaacagacgtctagcgagcctcataccctacacgcagcctccaattcctccgaaaattggaaggaaaatccccaggagcctgctcaaatgtcgaaagcgtacgcaacgatcgaaaactacagctccaagtgaccgttgtcggagccggcattggcgggcttgccacttcgattgcccttgctcgggaaggccacgcagtcacagtcttggagcaagcgtcagcccttgctgaggtttgtccatcccgtgccaatcaaacccccaattccaggcttctaaggctcgttcctaggttggcgcgggtattcagatccccccaaactcctccaagctgctcctgaaatggggcctaggcccattattcgagggcaaggcggttgagccacgaggaataactttccgcagatgggaaactggaaacgctattgggtataccaggcttataccagacttccgaagctccttcgaggcaccgtactatgtgatccatcgggctcatcttcacgaagccttgcacgaaactgccgtcaagctcggagtcacagtaaagctgaatagtagagttaccaagtataacgagatggtaccttctatcaagatgcaagatggggcgatcttgaaatcggacttgattgtcgcagccgatggtatggagtttttccaccccctcctctccgcttgtaacttggtgatggtctgaccagtaaacaggggttaagtcggctgcccgcaagcttatcctgggtaaagataataaggaccctatccggaccgggtttgcagtatatcggtcgacaatagatgtgcaaaagatgaaggatgaccctgaaacagccacgcttctacgtgagccggccctcaacgtttggatcgggccgcagcgccatgtaatgtcatacacaatcgccgcaggaaagtcattcaacctggttctctctcatgtagatgataccgatcccgccacctggcgcccggaagattcattggacaacatgagagcccaattcgagggttgggacccggtgtatggagcctattctaccgtccttttacatgctcgcccgctaaccagccgcttccagactcacaaagatcattgcaatgattgacaagacaatcaagtggcctcttctctcaggcgatccctccattcctagttggatatctcaatccggcaaggtcatcatgttgggagacgcagcccacgccatggtcccctacatgtctcaaggcgcggccatggccgtggaagatggtgcagcactggcagcggccctgtcccacgtgcacaccatctccgacctccctaaagccctttccgtcttcgatattgtgaggagaagacgggccggccagatgcaggaagctagtctcgtcaacggcaaaatctggcacttcgatgacggacctgaacaggccgcaagagacgaagctatggagccggagaccaaggggctccctatatcagaaagcccaaatcagtggactgaccctgtgacacaagcgtgggcgtacgggtatagcgcagaagatgatattcattcgtcttggaaccagttcaaatcaaggctattctgatacttgaatgggccagtcgctagagtctgacagcttgataatatgtacattagcgggccaagtagagaagctttcaattgaattcagtgaagccatcgttgctcaatgccttctaacggtatgacaggtcaatgcctgcgaaagcagccctaatgtaagcgaagttgttttgaccgtcttgacgaggtcagctatcgcattgaacagctaattgctgcgagccggacctagcagtcgtaatcaacagctgaattggatgtggcttatgacggccatttgctgcgggcctgaactagccgtcgcgatgaatagctgaattagctgttgcattggacagctatttgctatatataggcccaacattggatagataaatatacctgagtaggtggtgatcaagtgtaaactgcttgctgactcatccatacaacctccatggctttagggtaggcacttgttcttcaagggcagaggcacgaggcaaatgcccctccacctgacacttgggtaccagtcccgcattgaggctcgtctgccttcaacgtcatacctcaacgaccacccatcctcaccccggcgatacccagcttcaacccctacgagcccgcgcatatcaacccatcaacgccgccccagactcctctcccccccaaagcggctcgcaaagcggcacgctgcgcaaacatgaatcgcctcttcggctccaagccctcagggcccaaacccaccctcaacagcgccatctccaacaacgacacgcgcatcgccgccatcgacaccaagctcaaggccataaacggcgagctggccgcctaccagcagaagctctcgcagatgcgcgagggccccgggaagcaagccatcaagcaaaaggcccgcaaggtcctgcagaaacgcaacgcgtacgaggcccagaaggaccagctcgagagccaggtctggaacctggagcaggcgcagaacatgcaggacaacctcaagaacgtcatgacgcaggtcgacgccatgaagaccaccaacaaggagctgaggaagcagtacgggaagatcgacattgacaagatcgagaggctgcaggatgagatggccgacttgatggatgccggcaacgagatacaagagagcttggcccgcggctacgatattcccgacgaggtcagcgaaagcgaacttgatgccgagctcgaggcattgggcttggagcaggagctggaacaggaaatgggtgggggagttccaagctttttacaggacgaggtagtacctgagtttgtagacgaacctcctcaatcagaagacaaggtgaaacaggccgcgggatagtcatcgaaaacctcagcacacaacgattggggagttgaagtaggtcatatcagaaacaggtcattttgggtgttctagcaaattgtggcgtttgaattagttgtatttaatgtatcgtttcttggcatcctcctagccaggagtatcatgaaaggaactgtcgttcatcaacacagggtctctaggcttgatcgccgaaagacacagtatacatgaaatcatatacaccccttgcatcgtttccatcaagcttaatcatattcatgacttagcagtgtgatgaacccgggagaagacatggaagcatgcccacgctccttcggcaataattattaaaatagaatcctcccctcagcttaacgcccttattgatgcaatgcttcgttccgtacctccaattccgctttcaaatactccgatactctatgcatgaatgaatactccttctgcctagtgctcaatcaatggtcgcaaagaagcgactggcctcttccaattcaggatcaccgttacaaaaatcccatccaacgatcacgggtgcttgactacagcagacgatcttccgagcatcgaactggagcttgaacacacgagccgcaccgttttccggggccacaatatgagggtggtgtactcccgcagcaggttgagcctcattttctgcgggcaaagcatcttgaggaggccccgccgtggggagtggcggtagggctggggccgtgtgtggcagggcagtttgctgagcttggcccatgtgtagcgtctgcgttggtaggctaggacctgtagccgtggtgtggtctagctgtggcatcggtgcatcaaattggggaatctgcggtgtaggcagagcgcttgaagaaactgagggatcagatgaacctgctaccgctgccgtggaactgccaccagtctgctggtgtagctctgtgccattctcctgagtgagggaagcaacactggcacgttgctgagacaactgcgcatctacaacaacctgcacgagttgcgcacggacaaaaggcgacggctctttctcaatggtaacctgcaggtagttgtgatgcgaaaggattccgggcaatgttgtgagaacttggtgcaggattgctggaccggcagggacagcctggtcgatgagagccgtgtagactgctggcgagacatgagcaagagcattgtgagcgcgagaaaatggtgagttggccgggtggccggcgcttgaatgctgctgtgagcccggtggagggaccggtgatcgggagagcgggcgaatcgagggatgcaacaaaattgactcaatgccagccaaagtcgactcaggcacaaccgattctctctgctgggccgccgccgccgcctcttcttgtcgcaaatgatgagcgggcttccatacaccctccttgtcgcgtctccagataataatactgcaatcataagaaccggaaattattcgcccgtactttcttcctccacccccacctgggggtaactttgcaccgtaagcgacaatgtccgttgggcgggaactgcctgcgttcgtcctacgttcgcggcgccttgactgcgtagaattgtgttccacgaggccggcttcgacagccttgaagtactcagcatccaccctcctggcttcaagctcatcctcaatcttactataagggtagtcgccaaagccagcttgtaccgtccggacaagttgcgaatgaccacggagttgcgcaactttaactccagttggagcatcgaaaatgcagacctcatgatcgctactaccgctcacaactctccgtccgtcaaactcaacacaggctattcctttgtcatgagcagaaatagtctgagtgcatactcgttgaggccaattccagattttgatatgccgatcgcctgataccgagaccaccatgtcgccacgaacctggatggcatttacagcggcactgtgtccctcaaggctcccaatcatagtgaatgaagggatgaccgggagctcatgacccaagtccggatcaaacccatatcttttgatgttggttgccactggactgacaacttcgtcgaccctgtaacccgtatcaccgtatttgagaggtttacggttgaaaatcttgatgctcttgtctttggatgaagtgaccaaaatacggctatcaaaacgaacattgagcacggattcacggtgggctctggtcagccgctggagaatttccccagtggagaatctccaaatgatgatgttagaatcactgcttccggagacgagcaggtcttcttcggggcttgcatcaaactgaaggcacagcactgagcccctatggcccgtcaatggcgcacgaataaggcgccgcgtttgaagattccagatcctcatggtccggtccctactcccgctcaccaagtagttggagtcaaactgtagcgagtatatacattcctggtgtccttctgtagggtgatttggatgaggaagctgaaagggtaccgccttgcacagttcccaatttgactcgagtcgccggcgcatattatacagatacttccagttgatgcggtagcgagaatgattcatatcccacatccacaacgtggaacgtctcagggcgcgagggtccttgggcgggagaatgggaggtagtgatacctctggggtcatattccactcctttgctctgtctcgggatccagaatacgacccaaaacttctatcgactgacttgccccgcatgccagcgacgtccaattcagcgtcgcccataaaacctgcattaggcctgttgcttgaaaacgacgaagtgggtgacccaaagatgctttgagatatgacaccgtcgctaccgccaactctatcgctatcagatgtggacatgaacgtgtcctcatcatcgttcaaaattgcccggatcttgctcgtgtgaccttcggagttctggattcgatgcaagtggctaatggagtcgttgagcccaacattaatcttcgtttcccaggtttctatttcgcttcggatgactttccagccttcaaggtgatatatccgttcccatagcttcgagtccaacccgatatcgcaccaagcacgacatgtctggatgacactgacgagagaattggggtcgaggtaagacaggatcttgaggcagatttcgactggcaagtattgtatgaaatcaatgtacagtctaggattcagcttttggacaatctctgagatggttgatgttggtagttcgctcaggagcgccattgttagctctatgtggagttagcaaactgatcacgttgattgcaacggaatgccattcgcaggaggacctaccctttttgagcgatatggggagatgcgctgcattcgcagatatccaggctggcagttctgccgcagatctcaaggatgcgagcgacaacctgagatccttctggatggttgagtcgagagggtcctccgagtagccctcgtcaggctggtgtgatggggaaaacgtatccatgtgtgagagccagtccttgttagacatggtcatatgtgacccacgagtatttgatttgcataagattgtggctgttgatttggaggcgccggggggggcaataggcgaaccggtggtgggcaaacggctggcgggtttgggcaatggcttgggaggcggtcgggtgcgacttacgcgctcatcgacagcgcgcaagtgtgttggccagggcttttcgatatccccatggagcacaactttcaagagggacgatatccgggccaatagttacaagcggcgatgcctgtcgggattgacgttgcttcgcgctatggcaatgtcgtaagttgaggcacagggctgggtggagttttgatgatgaagtcagcaggagtaggcaccagcctgcctgcctacctactgggtggagtgccgccttgcccgtctgaagtccgggggaaagagcgccccaagccaaggtctcccgctgtcggtcttcaaagaaggaaggccccacttcgtttgtttacatggcaggtgcactcaactacccggtagccatcacattgcctgtcacaggtaagatagtagccctcatatggtcgaagcattacgtaggcaggttacatacggattgagagctagaaaaaactactaaggaaggaatccattctattatgcttttgttttctagctctagattatttttatagttcgagttggcatttggctaccacctggagtagacggggcttcattgcccagcatcgttacaacaatatcagtgcgacacaaagtaggaacgagaaccagtgaccacatttggcgaaccaaaaagcgcagatcacgatgtccccaacaccaggaggcaagcctcgtgcaccttaagggttttaattacatacggatgagtgtcagggtacggtaaccattttatcagtaacaacttacaagcataacttggattgaggtctgcccgaaacatattagaggcgcatggctagtttcgagctggagctggagctgatcgacactaaaacgcttccctatatccctatcttgaatatcttatagcgtctacgcagaagggctcagaaaagtgtgggagaggaacatgaacgctatgacggcaagcccccgaaagtcaccgatccatctcatctaacatccgacgaaaagaagccacaatacgtaatttcctattactggtagccgcgtcggagaattatacttattgtgtttccacgagaaggtaaagttgggatgttttagaactccattcctggttccgaatgagagccacttacatcaacagtagggaggaggacttggtattgatcggaaaagacgccattttcatggggtttccgaaaagtccatgtagatccgcccggcgctgatcgcatcacatggcctgacaactttcaggcgatggccggaagaagcaagtagcatgaatcagtcagtggcagcagtttggctaatgttgcctcctgaaataaatgggtagagtaatacgaatcacacccaagtgtggcgactttgatctgacggatcactggcaggctcggcggcggaggatcctgcactgcacagaaggtctgctggttctatccaaaaggaatgcgcatgtcaatcgtctttcagcagccagcacaggaagtcggacaatcaccttggtggcgcatcctcgttgcttttttgtaggaccagccgaccatccagtgtccctctgaacttgactgtcctggaactagcgccgagcaggggcaatatcactcgtgttcttcctctggagctgtggtatcacacaatcggtacgtggtagccaggcaggaagatctcaacctaagttggtagcgtgcgcctagccaaggctgagcaatgaggagctagagagggacttggcgctgaagatatcgtttgaataccaggcacacctagcgtcccgggtaggatatttgaaacgagctggcccggtccagagagctgttggtgtctccaatcatgcccaaccagcccctcaccccctcccttgtcctatcgtgtgtcttcggatgggtcctctctgttcatgcttcgtaaatgggcatcctagtactcggtgagcatgaggtatggagtttctagtagcctctcgcagatgttgcctgggcctctcttctccgacctgcataccgcctgcagaggtgtcggatgcatgggatgggtttggctaggggtgccggcatttggaccaaccaacacgataacccaagctaggtgatccacggcccgttgcttgtcgctgcatgctcccatccacacagtatggcggtgtccaagtgaagaacgggctgacgggagcgtttgctgagcaaaaccaaccccttctgggtgggtaataccgcagggcctggaggcaaggtacctcccacacacgcaagctcccgacgtggttgctgttccattcgggtggtctgcctcgattccgctcgtacatcgacagcttgcaagaaacagccgcccgtattctggcagccggcttggtctagtggcgagcactgtaaggcaatcagcggcccctacggcccaccaaagtaggtccctgggtccctactgcaaccactaaaggattagagaaacaccaccatcccattctggtcacggccactcccctccctatttcccccctcctccccctttctctctgttccgcccgacccacgtgttccgtcaccagccaccacaaccgaaattgttgtctgttgcttctactatccagcgacgtacccggcagcatagttcagcctggtaagccaacagcgtcaccgggcgtcgaatccgcatctcagccctggcataataaatcaacttgaggcacttcccggcctgcccatccagcccgcgaccacccttattcgctcctcaacccctcggtacctgtgcagacggtacaagcccctcagccaacggcgtccacaccggctccccttcgaccaaacgacgacaacggcgccagccacccagaacgatccaggagacctccacgctgagccgaccacggccaccgaccgattgtccttctctgttgtctgcgcagcccaacagacgactgcagcgattaccctcgactcatcgacggtagcttgttgtgtcgccgtgccctgacggatagctgcatcaggccccattcgattcgcgcatgtggaaagaggagggaaaccaagggcacacgacaacgacgtagcgacaccacgtccgacccgatcggtgtatttcgtttcgcctctcgaatcgctgcgcccacgaatcgaagcagagggattgtggtttgctgccggagagacgaaccccctcaacacgcggacccccaaagcccaggttgcgcattccgacgaatggagtaaagggttatggctcaggcctcactactcaaatttgactctggcctcatcaaaacatcgtctcacattaaaagaatgagttttgcgtcccgtaccagtcagttgtccggctcaacggcttacgctggctcgtcggcctcgctcagctcaatgtcgagcggggctaccgtggttcccacggccaacattatcaaccagaaagcagacgcctctaggtcgctgtaccaaatatgtgtcacattaaagaaccgcctttcccaggtaccggatttcgagccttacctgcagcagcttgatcctaccgacccggtcgatccattatgggccctcctccgatctggacacccactgctcaccatctataattctctacagcctgaggtcccccttgtagtggaggacattcctaatgaggaaaagcgatccaaaattgccatcttcaggttcgtaaaggcttgtaaggaggagctcagagtgtctccccaagacagctttgttattgccgatttaacgggaaatgacactagtggttttgtaaaggttagtttgcacgcctgctcaagacagacgctccgtcgctcgcagccatttctccttggcctgggctaatctggtttctaatctaggttactcaagtggtcaatcatgtgctagatctcgcccagcagcggggtctcctgctccagctggactcccactttgttgaagatccgagcagagataacccgacaatgaagatgacatatcgcgaccacatcgtgaaagaacttgtcgacacagagcgcaagtatgtacaggatctggagaaccttcacgacttaaagacaaccctggaacagacaggtgctattcccggtgatattgttcactctatattcctcaatatcaacgccatcttggacttccaacgccgctttctcatccgcgttgagacaacgaactcaatggcaacggagtttcaaaaatggggcacccctttcgttatgtacgaggccgctttcgacatctatcaaccgtttatcgccaaccaaagaaaagcagctcaggtcgcgaaccaagtcttcgataagattcagcaagtcaatcatcctgtagcagctgatttcaacacactggatggatttctcctcaagccaatgcagcgattggttaagtatccgcttctgttgaaggtactgttggcccctcggatgttgaaatgcaacgcgctaacgaccgtgaaaggatctgaataaaaagaccgaagaagaggatatcaagagggacctgatggatggttgcgaggcagccgaacgggttctgaagaaggccaatgaggcggtaaaccgagatcttttagacgaagccctcgaagagctgataagcagagtcgacgattggaaaaatcacaaagtcgagcaattcggaaagcttctgatgcacggtgtctaccctgtgattacgggcaagacggaccaagaaaaggatgtaggttactctgcattgctcctcaatgcttcccaattccagtattgtgattgaatgctgacctgcttcttagtatgagatctatttgtttgagtgcattctgctctgctgcaaagaagtggccccgagcaaaagcaaagataagaaggataagacgaggtcttcggggcctaaaattagaaaccggaatgcaaagctccatctgaaagggaggattttcatgaataacgttaatgacgttatcactctttctaagccaagtgcgttcaccaagcgaaatctgttgacataggctaaccggggatttcaggttcaggttcgcatagtgtgcaaatctggtggaagggagacccgggcattgagaacttcaccatcaagttccctaacgaagagttgatgaagaaatgggccgacggtctcggcacccagcgcatagagaagggtcgagcacaaagtggcgtggatcccaccaatttcatttggaacaaggacaacccccccgaaaatccgtatcttaacgaaagagaggacgaagatgaagacgaagacctcccaccagcatccgcaccagcacgatttgggggcaatgttccccgcacatcctcaaattcaagtttacgaggacggtcaggcaccaacgagagctcacagtccttgtccagcatgacaaggacatctaatcccaggtatcccatgcctggacaaccccccgctcccctgaatctcagtacacatacgccgggcgctgtttctccaggtacacggggaggcgacagttacttttctcccgtggagccatcacaatcaccagcctcctccagagctagcacagccagcaacatgacgccgatttataagcccggtactccccaggctgtctgggacgaaccgcaacgacacacagccccggcaatgccacgagcaccgtctcgtgatggatcgtctcctaaccaacatggcgttaatggtaggggtaatcgcggaccctcactaccagccatggcaactcataatagcgccgcacagcaacaacgggttaggtcatacagtacgcccgatattaatggccagggtggtacgcgccagcgggcgcctagccagagcaatgtccctgctgtacctggcattcctcaccatctttctggtcacgatggcagcgttcctcggtcacagactggatctcccaggaatgatctaccagttcgagcgaacacgcagagtcctggtgcccagcgggagcgaatgcatcaacattctggtagccttggaggcggtgtcggtcattaccctgggcatccagtttatggatcacgtacaacaacacccaaccctcagggcgggagctctcttcgagtcgagggaggcggcgctaatgcacgcgccgtgtcaccatcagtgaattcgggctcatttgcaccacctgggggtggagagatgcctttcccgacttcgctgaaggtcaaagtcaactgtgacagtggtaactacgttactcttgtcgtaggatacaacactgcctaccaatctctcatcgaccgtattgatgctaaactggcgcgattcaccactagtagcattggtcaaggcatcctgaagctaaaataccgtgatgaggacggtgatcttatcaccatctcgagtgacgacgacatacagctcgcattcggagaattccgcgagatgcatgcgggcggcgttggcgaaatcgaactgttctgcgttggtgatgctgaaaactagtgagcttagcgatcgatcttcaatttgctggaagggaattttgtgcgggaagcatggggttgaaactcttaggataccatcaggaggaacggcacttcaggcgcttgggacatttgatattctcgattattgcactcttatctaacatgggagggacgatggtgagtgaagcgcgagaggaggacagagcgcatcttaaggggctgagaacatacatatagatacggcatcgtagcgaagtacatctattattggttttattcttccatctcaaggattggtaaatttacattgtttcaggttgacaatttcctgctctttaatatttgacgcaattttcatttgtgatccgaacccgacctgggctatgtcgcttcgacgggacgggtgccatgtcactcagccttcatttcaacatgaaacgcaatacaagtggttccgcccaactttgaaatttgttcattgatatggtacattctaaagagcggtctcgggcttcttgtcccggacctttttttagttacaagtacagtgttatcggatattctgtgcaacccaacgccaggaaatgccaatttcagcacctcatcaattcgcccgcaggcaggacctctggctcgacatgagtgcccctcattatacaacaaatgctcccatgtgtaggccccaatcgagtccaccgcttgcacgcttggaaactctcccgcgatatgtaatggatttgtcctccacaagagcttcgggcacgagctcttttttcttttgttttcttttctttgatccgagagaaggtactttctactttcgcttcggcttgcttgtgacgtccttttgcatgcgagtaagatggtagttgatcgtgtttggcttcgagccggggggtttggcgccgtccatgcatgatcggagctggttctcaacggccagacagcctgctgcattgtacccggcagaggcccagcaggctacaaaagaatgggtggttagctcgtttgaattattcctggtatatgtacttcgtgaatcaaatcgaattgacattccgggcttcgatcggggaggtgtagacatacccagtaccgtggacatgactgcgatgcatgggttctcggggactcgctgggggttgtggacgcggagggtcttcagcgggggaagacggattgctttgtgcccggccattgtgtgaggatctgttggagtagcggcaggacctggcgcgagaggcaattgggctggatatcacggtcgtttgatatggattaagccatcttgctctgcgggagcttggggaaattttgagatcacgtgcgccgcgcatccgcacgtgacacccttcatcgccaatcgagtgtatcctgccatcagtgtatgagaaccactgcataaaaagcgatcttatttgccccattaaattcgcaagtaggattgattgaggagttgtatcatattgagcgagatcatggatttatttatcacggcctgatctatctgtgcctgtttcaaggccaacaaccccgactaaagttcttgtgacttctttcctggggtatgataaatcgcaacacttcaactatccgtaagtagggatcgtcttttggcatcttcgaacaccttctttctttataattttgcattaccgccatcaccgtggtttgccagaccctggttggtacagtcaatgcttcgctccgaataaagccctttttcggtttcctcgccagggattcccgttctttgagtagtgtgagcgggcgctggagcttgaatcgtggatgatcctcctatttgtcgttttggcataacctttggcgtggcacctttccgcaatttcccccacgctgattttggcggacgccagggggcattacgtttctttctccggcgatagagaatgtagccggtcaaaatgaggaggattggcactccgacactaagcacaacgatcagggcggtcctgtttggggtgtcgcgacttagcaaatcgtttagcgagctgcctcctgggatatatcgaggcttcaggcttccccggggaatgaactcggtctcatttctgtatgactgatatacggattggtcagtattaatttcattccatgcgaagttttggctagaaatgggtcaactaactggtttggcatgcggtattctcatatttaacgtaacctttgcgcttaagaaatctctccgatggctaggcaatatgtgctggaaaagaagctttctgaatatatttttttgtttatttccatgctcggaaggaatgcactgtttaaatgtattgacttgatttttgccaagcttctagacgttcgcgatgatgaaagccaagcttaggccctgatcaccgtcgtggctgtggattgagtgatgtgcaatagatgtttcctggttcagacgttcaaaactgcggatttggacggtcaaggacagggaattctgtaacaaggacacttatgaggtgctgccacgccatagcttttgcttcatttcaactccgtcgttgcaatccccagcttaggtgtctagaagccttttgaggcgttgtttccttgtcttagtaactagatattgtgatatcctctacccatcagccgtatgcgcttcggcagtatcctaagctctctgaatgccaactgaagtgaatccgatggtataatagaaaccccgacggggcagcggtagttttctgagcctaaatatttggttcgaatagacaggtacaacagtctctgatttcgctgcaagaaccaccgaaagaataagttgcaaaacccggttcgagattctcccattgacgtatgagaaggtccctgacatctccagtattccttcggacgtgtatgaactaagtaatatgatgaacctcattcggggtaaaaatacatggaggaccagccgccggattttattcattttgtaaacttttcggtattagatagtaaatcccacaactccagaacgattcccatcatcagataacatcaaacttttcatcgtccacgctctgggagggggcttggctcttgctaatagtagcccagcctcgacgaacgggcatggcagcgggttcggatttcacggccactttctttggcgctgcctccttctttggcgctgcctctttctttggcgctgcctctttctttggagctacctccttctttggagctacctccttctttggtgagacctccttctttggagcagcagccctccgggccggcttcttgactggagggggttcttcctttatcggttcttctttgacctcctcctcctcgacttcctcctcttcaacctcaccatcattgtcgtcgtcgtcttcgtcatcatcatcgtcatcatcatcatcgtcttcgtcgctagagtccccagacccttcgctatcaccctcacttccaggatcgtagtcctcctcatcctcatcctcgtcatcttgtagtagctgctcagcctcagcctgagcgcgctccagttcagtcgtgccgttaggagctgcgttggcatctgtcatggtggcatcgccattctcgccctcgccgtcctccttcttcgggcggttctccgcgagctggagcttggccttcctctgctccgccatgctgcgatcctgcaggcggttcgtcttgatgtagtcgtcgatgccgccgtagtcctgctggtccagcatcccaaactcaaactcctccaccgagtcggagcccaggaggacctcaacgacgatgttgaaggtcatctggagaatgttggtgtagctgatggcctggatccggttcagggggatgaatatcaggggcttcttgaacccccacaggatgccattctccaggaagaagaggaacccgtccttggagcccctgtacccgccgacatggacggccgcctccttgggcctgtgcgactggcggatcacgctccggaactggctggggtccgcagacacgatcttgacgtcgttcccggccagcttcagacggctgccgatcgcccagtggaagagatccttgtatgtgtcggagacgctggccgcggacgcagcgtccttgccgccaatcgtgccctgcttcggtgccgtggcgggaactgtgaagacgagcggttcggcgggcgcctgctccgtcttggaagggaggtacgagccccgggggaagaggacgtagttgtgctggacctgggctttctcaggaacgggcagatagaagatatattcttgaaacacaaacagagttagcaagcaggcctggatcaaatataaaaggcatggggtgcaaagcacggtaccaatgtctgtccatgcgtatgtgatggccgggattggggcggttgtgcccggggctcgggcgtagatgtggccctcggcgaagcagagctcgaacttcttgcgctggggcacagaaacggatatctccttgacttcgagcaggacaggttcctcggccgcgttcgctccgccggcggacgttccattcacattcccagagtcaatcttcctcttcttgttggccggctcggcattcgtcgacgcctggtcgctcagatgggcggcgatttcgttgaagagggcaattctccccggcgagtctgtatcgacgcgattgattagcatgcgatgatttttgctggccatatcgcgtggccgatgggccagacacgggatccgtcatcgactcgacctaccggcagctgtctgaatcccggctataatatctggccgagacccaaaaatggccgtcaacctctgggtatccaacgattgactcatgctttcgacggtatctctagagcctctagagtgcaatagggagaattcgaggctatgaatgggtgttcggtttttttgtttatctctaccaactctggagtgacgaagcgcctgcttagtcatgcagatggtcaatagcattcacgcctggtcgccccacggcccaagagcttcatgttcatgttggtcgtttgtcttgaagtttaagtaaagcctcattacttcgaggtgaacttgtgcctcgtttgtttccctggtcagaggatttcgctcgagtctactacccgtgggagcgggctcctcttacgagatggcgacgccgtttcccaacatctacacccatcggaaggtcgctgagacggcttccaaggcttgcgatgtctgctacaagcccagcacatccgtactaataaccccagataagaaggtacggagatgaaatgataagccaaagagacgaatgagccgatggacgtatagtgaaacggtgcaaaggtcttctaacccacgccactaacaggacttcttctacatctgcccagtccatctaaaggaccgcaactttgctactcctaaaattgatgaggaggccgtcaaagccaagcgggaaaaggagcttgctgaagaaaaggaaaagctgatgaaggagtacgaggaacggcaaaagaagaagaaggaaaaggaaaaggagaaggagaaagacaaggacggcaaagaaaaggccaaggataatgatgaagagaagaagaaagacgaagacaaggacaaggataaagacaaggcggtaagttcatatccctaggatacctgtgcatacatcatgggagcactgacaagcggatagaaagcggacgatgagaatgacactcccacggaagaggagcctcgggtgttcgagctcaaacagtaagtcatctttatattctacttgacctcgactcttttccacagctactgactgtctgttaccagcgtgttctaccaacagaggattcagaaaaagaggcaggcagaagctgccaaacgagaccgcgagagggcgtcacagcccggttacttcccgtctgtgccttcagatcttcccagtaggtgatgtctagaacatgaggtcaacgtgtttggtgggtttaatgcataggccttatgaggagaacacttgcactgtatccgactactgtatcacggcggaggcactcatgccgtgcgacggagacggacggctggcaaatcatggacggatgcttatcggcctccagtctctacatccagaactcacggagcaaacaccctttagcttacatgtcgtccagaacgccaggcaggacgtgatgctggattgagcgggcgtccgcggctggtgggaagcagttatcttggcctgatcaatctccactgtcgatttgtccaaaggaagccagcagttctgtcccaaccccatcgtatcataatctgactacatattggcaaaccacggctcgctcattcccaaaattgcgtgatgcgcgacccctctgtcagcaacgctggcgtgacatatcttcctaccatgctaccactattcctcccccgctttcggagatagatcttgggaacaaaggaatgatgtgcgtgcggaggaaggaatgggcgataagcaagaatgcaattgtaattccagccgcctctgagaaccggaatcatgtttctctggatgtagctgtgatcacctgtaagtcgccaactaactaggcgttcaatggttatggcctcacgcccagccccctggacttcccgttataacagcccagggggtgtaaacaaatactctggatgtgtgtgtgtgagaaaaaaaagccgctaaataagagcgatctcatcgatcgcctgtactttattccagaatccgagcagcaattggagcagcgctgggcccgtcggtctgacctatctcaccatggcgtcgcgtcaggcggagttaactggacaagtctatccccgagaccttccctccaactggagaagaacagaccacatgaggcttattatactgggcttttttttctctcttctcacttggctcgctgccggacaaccagagtcccgcaggcaatgtcagcatgcagcgcgttctgactctcctctcccacaaggggcctagtgcttattaccaaaagcacgagagtccctttctgagggattcccccagggtcgcttcttcccacgaggagggaggtcggaatgaagtgtacttctgcgagtctacgtgtggattcccggcgggacaggccctgggccagcgcagcagaggaaggtaggtaaagttcggaatgccgctggtcgagaaaagtgccagtcgatccctcgggacggatgacctttgacttacggcagcggcttatcgctgatcgcagcctctcagcccagatccgcgcatccaagcgagccctggccgtgctcggaggagagggtccaggtagcatggccgatgtgcgcagacagaacagatggacagacggctcatacatggccccttcccccctcctatgggagagcaaagacggaagccaaagttgcttggttacaccggccgggttgttctattatgcagatgtagtgctcgataatcgaacccccgagacagcgagaaatggcgggtcagtcatggccggtgtcgacctataccagaaaagatatgattccagccagcgtcgtgatggacctttctacacccaccatcctgggaatatgttgggttgatgctttaaccggacccaaacacccctcccttctgtagaaagataaacatccccgccagtcgcagctgacatgcttggcccagacacgcacttccgaaagctgtctctcttgcattggtaatggagaattgaagcattgggcaattgagagagggtcgcctgacaggaaagaaagggtcccttggaatcaggtcatggcgcaaacgccatcgtcaaaggacccttggaggtccggcggtcggactcgagcaagtcgagctgaagagagaatccagcagcctcacaataagcaccactagggcttcaggtctggctttagggaaagggtctcttgggtttgggggccaagaaaaaaaaacaccacaggaatagtagcagaaaagggctatgtaatccaggcggaggaagggttaggtaacatagcaaacgagagatatcagcttcgatgtagcagtgcgtcctgccctaccccgcgcaccatgatcgaccgaaaaccctgggcgggattagcctgttggcggcagtgcgtcactcgtacattgtagcctcgaccagggatagggattgtatgtaaagggaatggaaggagaagggtgagggcgtggaagagcgaaaacggtcggggtgaagggtggtgatggtacttgacggccatgtaccgatttctctgaccccatggggcctggataggacatggccctggtccaccaatgtcccttatatttttctcaaccacaccagccagccaatcgccggggcctgggtacttaggggcggtcaagatgatggtgatgatggccttgtctctcggccagggggggaaggggggtgcccgtccgcacagttgaccggattgcttgctgtgtaggggaggcatgtaggagccaagcagaacgtgcatggacatacatacatagtaataggcgcaggacaggacggacggggacggagactcgggtcggacttgagagagagggaagcgagcgaggatgaactggctcacgttcgggccaaagttgctaaaactgtggccgatacgcctcgcctcgcgcgtgtaagcaggcgccgctgcacgctgagcgggcgggaggcagcgtatacgcatacgacggagcctggggtatagcagatatcggcacgcacgtcttcttttcgacaaaagtgcattggaaggggtgtcgtgctgctggttgtggtggtggtggtagtcgcaaaaagtcacagccgtggtcgcatcgtggtggattcgagcgaggcagagcccaggagaacgaatggacgtgtagacgccgtgccagcctggctgtctgtatgtctctctctgcatgtatgtgttatctgcgtgtctgatgtagatgttacgctgggatggtgttgatgcttgggcactttgggctcggaggcctgtctagctgaccgcactctgccagtccgaggcttctctcatgtgccagccatggttttgcaggcttggtgctacataataaaccgccatgttgcagggagcattgcattgcatatacagactcgcagttgcgagctacgtgggacaagaaatccacatccgccaggtcctcggccaatgcctgcgcacatggacatgcatgcagatacagatactactctacctacatacatatgcacatacagtacacttacaagggccgtgatgcaggttctcgtgggatgcgtgcatgtcggccaaaaagccaagacgccgcccacggtcaaggcggcagagtgaccggccagctcggtggcatccgcccagcgtcttcggcgacaccgagagcacatccgtcatagggcatgcagaacatggatcttttttgtcctgatcctgctcttctgtctgctggcgagaatctaccagccaaacaaggtgcaagcgtgctgcacaacgacgcacggggtgagcagagatggggggagtggaggggaaacgggagagaaaaaaagaggagagagggggggaaaacagcaggtcgtacagccaggtttttgttgggggaagtcgtttctttttgctgcagggctgatgccatgcgatgcacccgcgggacacctggctcccacgggcttgaaaaacatcgccgtcttcgtccatcccgccgtcgcactcgtcacacaagcccgcacggctcgcggactaaggaagcttcgaccagcccggctccgcgttttcttgatctggctcgagctggccatccaggcttggtagattccggttggctggccggcatcagaacgtcatcgcagagcggtagcagtaggccatcgcatgcagaatcgtgaaagataccaccgcatttgggaagcgtccagctcgatcgccaaccaaccgaacaagccattgccgttccgccctccccctgaagggctgggccatggactttgtcggcttccatggttggtctgttgttccccacacgatcactcgcccgtccagtcaagctagagagagccacccccctcacttttctcaaagtcccaagcacgaaaacagatagtccagagtctagtggacgcgcctctagttttctctttcttcttggagtaagcagcagccctgtacggtaagaatcaggcaggttgtcgcgagataactagtttcgctctctcgcctgctcaccaaagtccgaaccgtcaaatcgcctagtcatattgagccttgctgggatatcaggtgggcaaaagcggaggcgctctgttttagtttgctgagtgaggcaagaaaagtcagccctaaaatcgtgagttgacttgacatccatggatagggcatggatgctatgctattttgtttcggaccccaacccttggagcaaccggcgatttttaggcctagcgaagccatcttagtgctaataagcggcttttccctagacggtaaaacatatcgttgctaatttcccccatatcgttggcatagtccgtgcgttccttctagacgacatcagcatcagcatgccaagcaatagcctctttctctagcctgacaagtggttatcagaactaaacgactagctgtggcctatattggaaaatggcaatacgaaaaaccgttgcggcccgtgtttgtctcgggccaacctgcctgattcctacagtacagggctcttgcttactcccaagtctggaccaagaacaaagcctcacataagggaagaacatgtaaggggtcaacagggatgaaggatcaagatgtaacgcttttgtatttgcagagctctaggcagaagtgaaaaagtgtccagggcgagccttgcctaatctcgcaagtaacagtcccgccacgaagataggggcctgcacagccataacgctgatagagacatacctatggttgtcggttctgagttgctatttgaccgccgctggtctttagcgctgcaaccctgcacaggatgagagtataggtccttaagagacgtttgcgtgggtgttatctagaagccaaatgccgaaatgaaatgggggccaatcaaactcccggtctcgaaccgccatggctagcagacaggggctagcgcttaagtttccagttgcggcgggggctaagcctcacctcgagacacactcccttatcccaaaatgatggttattttgcgacttggtcatgagatagatccgcctctgtgtagtaaattcataagtcgaaggaagattaccagtgcgggacgaagcctccggggccccggagccttacggctacaccctggaaacccgcagacggcttgtggttataccttgtacaacctgggcaacatccagcaaagcgatggtgtaagccgaaagtacctggatcgcgacccttgcataggtaactgacatgtgttgaggtctgtctacaaggctgcttctggtgcacggatgattaccatattgactcatccatatccaattcagacgcttactagctgacattgaccatgaagcgagtacttcctgttttagggggcaagcgccgcctgcataatgtcatcgtatagtaaacccaaagtggaacaacggggaccgtgggatagcatcgtcacaggttgccacctcgcgcccccggcggcattctgatgccaaagctctgttgctgtccagcagcagacgaggaggcgtttaggatgacatcgtccacacgccctcgttgaagcgaaaacgccggcgtcacccagcccccgcaggagcacttgaaccccttccaatcgtaccgacccacgccggcgccgcaacgagcgttggggcagagaagtcgcccgttgagcgtccccttctcgagctcatctcgcatccagctcaggggctcgataaagtggtgctggcattgtgccgttgtctgttctgctctctggtggtcgatgatgaagggtgctgtggccaaggaccgtctgcacttcttgcaccggaggctgagcccagggttcccagctgctgtcctctcaccaccatctatttcgtcctcgaaccgaagtcgcgaaggggcctgtccgaccgcaagatgctcctgcacctcccggtcgtacgcccagcgctgatagatggggtgagtttcgatatcaccctctaccgggcagcccatttcccaccaaagctgcagctgtttcatgaacccctcgtttggctctgccatcggccgtgtacgctggatccagccaactgcggcgtcgacagccttcgcggcggtctcccggcgtgtctggggctgcggggtctcggattggttgggggccaaggatgagtcaaatcggcctgggaaccgccagagaagataagcaacgacggcggacactgatcgtgattttcctgcggcgcaatgcacaaacaccgctccggatgacccattccctgaatgttccgcccccaaaccctccccatgatcctggctggcggccgcctctccttgcgcgcccaaatctgccgggctactacccaaggcttggctaatgaatctcaccgcgcgtggcagctcgatgaggaggttggcgtcctctgtgtcgtcaatgtcgatggacaagtgctctatctcacgcccatactgggaccatggctcatccttgaaattcttcagagtggcagggtcaatcgcaaccatggacaagacatgggtgatacgccgctcaacaagagaatctgaccgcctcatagcccatagcctatgcgataccgttttgttagctgttaatcacttgttgattggaggcccgtatggagaggaaagggacaatggggttcaaggttaatagcctatcgccttgcaagaacatacccgccaacgtagagctcctctctgccctcaactttgctgagagccatctcgacaatactcttcttcagagcttctaattcttctgactcgaacttgtgcccaaaatcttcccaaacttccagctttgtatccagtggatcacgtccgtctgcttgagtctcagggttgatgtgactttcaagagccagtttgaaggttggccccggcgggggttaaaaatgtaaaaaaaagaaaaatatgtttgtacccggaaactggcaatgtgaggaatgaggagacttaaataatttatgccatcaaatttcacgttgcctgaggggattaccagagtgttcttgaacagtaaagataaagttcctgtagccttggtcaacttcttttgtctcgccgactgacgcacagatatccccgctgcgtgtcaaatcttggtcctgttggaaaagctcctcccgcgattgattgctgagcccctcccgtcccgtccgcaccgccacaggagctgccattccagccacatggccactagccacagcgcattctcccctaaaaccaactcctgcccgacgtcacactttgcgccgtagcagactcgcgatgacatcttacctcatctacatatgcgcaaacaaccccctgaagcgatgatccgcggaaagtgtggatgccctcaagttacacgccctcgcagtgcatacacctactaatgagatagagcctcgcgtaaattagtgaggatgcttggagtcctacaaggcataacgcagttatcaatgggtacgatccatcgcggaaagacgcctcgtggcaagatgaatcgtacccttccactagcaaaccccggccgtttctcgtgatggctagttgcctatacgatgaacgcccgacagcgtaaaacaattaattaaaacaaactctgttcagctcccccactcctcccccaaggtgtgtgtccctttcattccgcactcttcacgatgcatcacattttgattccgcagtgacaccgttggaaagggaatagactatttaggctcatcctagactaacgcctcttagctcagctgcgtctcagctctgcccattcccttggtagatggctgcccctagcgggtgggcgacaacagtaatccacgcctctttctcagccccaagatgcctttaacgacacgacttgcccgttgtggacctccaactcacatctgcgcatgcctcgcgacgcctccggggcagtcagccctcttcgtctcgaaattcgcactaatcctacaattcaggtgacttccagtcacctgttgttttccaatctccaccaaagttgcgctatagtttcccggactatgctagttccgcgagtctatctcgagtccctggtcctatcctcatcctagcgaatgatgcagaaacacaggaggtaggtttaataatagatcagtaagcaaaaaccctatgcatgctgcatcacatcaaaaagcaaaacaaaacacgaggaacaaatcttaaaaacacaaaaataagaaagaagaagaaaaaaatccaatatttcccattggcaggtgtggtggccacaggaacaacaaaagcaatatgtccgccaccattattgaagccctaccaccaaagtgctttaaagctgcccctccccctccccaggcaaggatgggcaggaccaatcaccgccccgtcagcagggatgccggccgttcagccatttagggcggacgcggtggcgcacccttcacatggcaacttggctgctgggctgatgtggctgtcgtcacctgtcgcccatgtctctctccttaactgggctttcggcgaaccatccgaaaaaaaaaaagcttgctgaggaattcggcgcgcgcgtggcccaagttcaataaggtgcggcgctggggaaagcggtaaccgctagagagagaagggaaatgtatcgtcgtcggcagaaccgttgcgcgtcgccctccgcttactaactcgtcggggtggtaccacacaccgggggcccttttcgatgctgtgtgcaagagcaaacctacagggtctgatcctgcccggcttcggtccatgccaagcgcactgcagcaggtacgcttcccccatcacgcatcccatcacatcccgctcgcaactgttgcctcagcagccctatgccctgctgggcatgcttggtgtcgctaagctctgcacctttcgaaactttaacatgcagcatgcgctgggcattcgtgcactggccaactttgcctggcctgggcccggctgagcagagatgcaacatgcagccgagcaagatgcctcgactcttcaggtagggtacattgataggtgtgcatctatgcataataggatactttacctatgcatgccggacggtttggcgcgtaccatccttgcgtaatatcacttgtgcatccacgctgttcctctcatggacaagcgagagttggaagacaagggaaggacacgactccccgatgagattcgaattctggaatatggtattttaagacaactaaatagcattgtcgattctttgcctcccaaacgcccaataatgtagtttaaaatgtcgtaactcgtatcgtatgtccatggatccagaaacacgtctctttcttctcggccatcgagcggccttcctttgagatcatccatggccgcgtggtagctcccagtgtttcagcttgttttccctctactgcaattccaatccgcatacaatctgcccctttgaaacctatgccgctttttctttatccacttactaaataatcccgtcaagttgcagccctgtaccacgcagcgccctttgaaatagagaatcttcgctgaaatagactcttttacctgtgctgtacaggctcttcgtcgatcatgcaggcggtctcaagcatattagtccacttcccgcttgcgccagcatgactgtgcttcaggtgctgtctgaagtgatccgcccggaagaacttctttgacgtgttgcattcgccaaatttgtggtaatcctgcaaatgccttgatcgctcctcccagtcccgttcggtgacatatcgggggccattaccacctggaccacggcctgaacgagcaaagtcctcgccgcagtatccacaagtgtcagcttcatagggccgactggttgactcatggaaagctcgcttgtaatctttcaaagccgagcacgaccatgagtgacgtcggacatgcagagagttctggtgtcgctctgcttcgttcttattcttgaagcgattgccgcaatattgacagttgtattgcttctcagcttcatgtgctctggcagtttgggttagattcgctcgcaaaacgtgaatataggccgccaaaatgatacgtacttgagatcctcagccgtctcgaatttcttgggtttcttaggacagcattcgcacatgaagaatccttgcatcttaagcccaggcttctgtatttcgggaattttcctcgggcttgcgcctgagacgttgcggtggtgccctgtagcccgtccagagatagaacccctcgggctagggttaagggactttggtgtagtgtatggggaggcggtggaggtgggtgagataccgctaggtgattgtcccctgggagagcgacggtcgtatgtagcagcgcttgatgggcctactgagatgttggatacgtaggagcttgagcgggaaagtgaaggcacaggcacgccctgtgatatcgtagcaagacggggagtgggagagcctcgagggttggcctcgcctcggcgaaggaggtcatccgaaggtgcgcgacgcttttgcccagccaggcaaacatcaccaagctgaagccttttaagagacgaggtctcttcgatttccatctcctcggcgccgtagtattcatatccaccgtggactgatgcatcatcgctattgtttctagacgatcgagttcgtggagacctatccatgtccacgctctcttgcggggatcgacggcctgtgtggctgaagggtgtagatctgggtgagaatgaggatgcctctgacatcctggatggctcgagaggtcgtgggtggaaagggagctggtgaggcatgctcaggacggaggggtatcgctcgggaggcctcgaggagaggctgcttaggctgctgagggaggatatcggtggagatctgtcgacggggcgcatctggtcaagcttcttcttcatgctgtcgacatcgcccgctggtgattggaattgaaatctgtcgtggtgtagtccgaatccgaggggtgggaatgcatctctagatctagagatatgttagatctgtttgttatggcaagacaacaggcatctcatgttgattgcgctggctgtgctaacctttccattgatgaccagcttgagtagcttgagtaaccttcgtcgtggtcctcggtcttgattccagtaaccctcctctttaacctctctctctcctcagccaccgaggaggcggcactgccgtagccactgctcaaggagggcgtgaactgagcatagtctcgtcggtctattgacatagcttggtcgttggggttacccaggggcatccgaggaggtggcagtggaggaggagcttcttgtcggaggtctgagccaggaattgacattgctggactccttccatagggttgatcatcatgtcgagatcgaaagcgggcggcggcacctgggactataatactcgggaggctctgggcctctctctgctggagctccatgttgatgcaataatcctgactcaaggccctagtaatgggaggatgtaggaagacctagtaaagcccgggaggctggtcctcctcgtcatagggcagtgagtggatgggccgtcgtttttgccagtgggtttgtggagtaggttcagctctgtgattctggcagtggcgagcgcggtttcggggaggccgacgaatcacgaagcagaggtcgggattcagcagcacagcctggtgtttcgtcccagctggaaaaaaaataaacaagggatacaaatagaaaaggcggagtaggtcaagaagaggagaaaaataataacaaaaccaagcgtcgtcttggaccggccgagaggaccaaaggccaaagggcagctttatcaggagcaatgctgtggcgaggcgaaaagaaacgtgcgatgcggatgtcctatttcaggtcataccttgagtgcgaggtgaccaaacaaaccgctcgtcctatcttttcctcagcaacaagaattgccggatggctgagcctcttccctctatccttccctggctggcaattgacgatgctggtgtaaatcaatgacggggcgctgtggcgagttactgtgagatgcaatggcaatgggagtgacagaatgcagatagagggaggggtttggagtctgatgggggggacggggtctagtacttgaaccatgaacaacatcgaccacttaaactgctgaaatgagaagactctggctgagcagattggaatagcattggcatggcttcgcaaacggtagaggtgctgggggactcgcagggctggtcttgctcccactccacaccccgtcgacaagggtggcacaacagagacatttgcccattggtcccgtcgtcagagttgtggctttgccagggaggggtggacgttacgtaccgtggtacgtccgcgctgggatccgcagaagggcccgtcgaggacccacggaagtacctccctgcgaggtagagccaaaccctgcaagagcacacccaagcgcgggaaggagagggggggcgtggagcccgagcctgggagtcgctgctcgtcgtcaacgcccagggagtagcctggcagataatggacgcgcgcgggccccttgacatccaagccctaccttaccttatactggcacctacatgccttgcgaggtaccagcattgacacctccttggtgggaccctgcctgcctcctaggtagagacgcggcatgctgcccgctcactggcagctgggcgaccatcgaatagtcgctccggtgaagaagacgcctggatgcgtgctgggcaaacacaatccagggccggtgtgtcatgctccgtcgtgcataatccaaccatccgatcagcgagctgccaacggacaaccctattatgtatttaggtacatacatccataccctgcctgtgcaacttgggtactggaaaaggcgggttggctgttgcggactttcgtctctcagcgcctaccgattgagccgctggatgctccaatgcgtgactggcccgatccattcttacgttgttgtgcgcgtgccgcttcgagccgtactttggccgccgcgctcccgatcatgccatcaaatcgagcgcgcgtgcgtaccaggagtcggcgaccctctggatggtatggtcctgatcgacctcatcgcatgctccacctagtgaatgagcctagcccagagcatgcctgggcgtgtagggccatggaagggcatgagttctgagccaccccccacactctcccgacgggaaggcaagcaagcgggaggggagaatggaaggtacctgcacgcaaagtccccagggtgtgcgagagcgccctcactaccgtgcctatgtaggcctagctcgccgctgctgccacctggtattgggattggatggtaggtaatacattggcaagagcggtgcctacctaggtggatagtgcatacctacgtaaggccggccctctgacctcgagagcgacccttgtcccctcgcaccagcgcgcgagagacctaatttccatccagagggagcctgtttcacggctttcaagggtcattcgtgcgcattgagaagaagaggaaccttcggcttgtgaatggatctcggggcttctctgacatcgatcgccacccacggccgctttggcgatgattgacagcctttctaggaccagtgtcttacttttttcttcaatcacaaaggccgccggctgcctcctgcccattggcacgccagggtttgacccgtaacagcagcgcgcgccttgtcatcgcaatgtcgactcttggacggagttacggagttgagatacgggtcttggccaatatcgcgtacatcctaggtacgtggtgctactgtgtgtattgtcccttcatatcttcttctgcatatttgaagagaggccccattccatcccgcatccgaggcgtcacgtccggggttctcccaacaaaaactcgcctggcatcctgcggctaacagcgcgcgattgagccatccgcatctattctaggcagcgccctatgaatgcaggtcgagatctcatccatgcgagcgcgctgacaacgcagcgaggatcaatggacaaacctatgcgagtcctccggggagctatggatgcaatcaacacttgcgagacggcttatttctcaacctaggctaggcctagccttaccagcaacggggcatgacggcgcacattttccccctttcgcgatggcgtcgctcacgcgggagccctgcggtctcgcatgggcttcttgtcatgttctctgggctgtttgcatccatgttggcctcaattggcaacgttgatcagcgacaaggccacctgtaaggataaatttggcctagagacacctggttctgaaacaccggcaaggctattggcatgtggatctttcagttgaatcctcctcaagccccgccctatcaggcccaaatctattcttaaactgccgactttgggggccccaagtcctaagatactacccaaagtcccgttatcgagatgcctgtattagaataaggcgctgcgaacgtcaatcacccatgttgaagatgagaatttcggggtcctcggccaggcagcactcggctcggggacaactcgctcacgattctgtcagcaacggcagatggcatcgccccagggtctcatctcggcatatccaaggcggttcaaccccgagactgtgctgtgctgacatggctccaatttactaggtaatataacaacattggattgatctcaacccaggaatgtttccatctgaatgaggccgaagaccaggaattctccgacgatactcctctcccagaaaccttcaatctcaggcagcaaccattggattacatagatgaaggccctgcctgagcttttcccactccttcttgatcgcctgtgccgtagactttggctgaagctaattggaaagcccacgcgaacaactgtcagccctgcagcatgtcagcttgatgagtcggaaattcccagatccggtaattccaattccatcacgcatattctagccccaaaccacgttccatcactcttaaaccccgcccaggcatcatatcgccaagcgtacaaggcagggatcgcactaactagaggaaaatgagcaccatcatcgccatcatcctcagcggcgggcgtatattcccaagtcgccacggaatcatgcccaagggactggcgccgcccccaaccgctgagctttggtaagccttatcataggtgatggtctcgcgcgctccgtctctgcctctccactcctatagtccgcgacgtacagctgatagcgcgccgcgcatgccaaccatcgaagcgccatacacgccctaccggtggggccaggggaaggccatggctccctctcctgggggagcgagcactaaatcctcacagacgctccggcactccagacgttcagggatgtgcgtcggagtcaagtggtcgggctcatcggaggccgtgtgcccgatcagttcccaacacgagcaagcagtgacaggccctcgcttcatcatgattacctacctacagtaagacgttggtaagacctaacacattgtaatcggcctgttggtcactgacaatagagacgggaccgatgtaatgaaacctcactcctctctcccagtagtagcggtgttcacaactaccagaatccctgctcgactaattttagcctgccaaccttttcccctgaggctctaaaactttattgaaccttcgtctagttggccagaatactgctacgtgcgtgtttcgctcctcagatttgggatagtctctgagccgccggggaaatctaccaaccagagcacaagcttgtgggcgtttcatataccgaagttccgtcgctcaaaacttgtccattccttcccttcccttcccttcccttcccctctcctaccccaattggccgaggcacgacgggtagggcgaggaggattctggtgggagggtgatacccgatgagcaaaccagtgttttggttctcccccgtactcgcttattgatgccatggtggctggggacggcagctacgtacgcagcgtgcgcgttggatccccccgccgacaagggaaggtagagagggacgagggcggtttgggtgtaactcgcgcagaatatccactccggccgtattacgtatgtgtcatttggcgcccacgcgggaaagaaggggggaaggggggaagggggggggaaacagaagaagaagaaaaaaaatggacggtgcgaccttgacgccgccgcggcccccgtagggcttgggcgcttcgctgatctcccttaccctcgcgcagggattgggccaggccggctcggagcttcagctaccaacgacctgtgtgccaagcaagcttggctgccatgggggggaaaaaggcggccaacaagaggcgaagtaatttatagggcatgacatgcatttttcccaatcgctgagattcgccccaacatgcatgcagccttgattctatggtcccctcccccctcctcctccatccacccctccttgctcctctcgtgtgatgcgattcaaggcagtttctcgccttcggggttattggacgcgcgtaaaggggttctataaaccatcgatcactgctccatagggctgttgaagtgcaatctatagggaggcggtgctggtgcggttggtggggctgaatcatacgcaatgatgctacagtgaggctagcaggatacgaggggcggcgtctagaatattcactttggaaacgtcgcagtagggctgtcaagtcgctggaagtgtttattaacccacacctatttgcccgtcaacctgcacattaccatcgcaggtggggtcccctgggagtggctgcatagggacactgcagagcatgttccaacgtagcttgggcaatcataacaggcctggattaagacccgaaaacaacctccagggccgaagaagaagaagaaaattccaaagatctttcttggccgaggatacgagggcgatcttctttgcactgcaacgattcggcacaccctttccctcttctggtccccggagtcccccctggatcgcggagcccttctcggcggtcggttgcatgagaaagctggctcttgccatgaaacccgccagggccccaatatcccgttctgtcgggaaaacaagctttgagcgacggcgctgggccggttcgaggcatgccaccgaggctagcaaccatgattgcaaaaagattaaacccacatactgtatagaaggtacatgtagtcggcgatctaataaggctggggcggcgcgaccaagccggagggatcctcaatctggcttgacctcatatgtagaaagtcccatatcccatgtctgtcggaccaaggcaacacaatgagaagggcccgacattttggagctagcgagttagtatgcccgaggccacgggggcggagatgaaagagggcaaagtattggagggggcgtggaggttgtctgaatcatgaggaatctgagttttacaatgcactccgaaccaacactgtaatgatgtcaaaggggactacaccaagaagaagaagaaaaaacggtcgccgtccatccactacgaggagcttagtgtcgctacttcggggtcgggcgatgtccgcaaccgaaaccgagtaagtatctttcgtcgcaaaaaaaaaaatcataagaaaaaactagttgagagcgggcaaccgagtcagagaggctagctatcaaggtatgcatcgtgcatacctcatctggaagcaacggcgctcgctcgacgccggctcgattatggctttcgttagttccatgcttatcttgcctagcgggccgcttacaacgccaacgtaagggaatggtaagatggcacatgatgatggataatacactttctatggcttcaacttgcagccaatgtaagcttcaatacagggtagtggtcggttggcatggggcgggattcatctccgcaaggagtgtcatggatgcgtcaaaaagcatcgaaggggctgaactgggggtggatcttcaggaccgatcagcattcagggaaatgtaaggcggaaaacgaccgccctccatcaaggaaggctaaggcgtgtagtaagaagacgtcgatgatgacgaagagggaaaatgagaagggcgggaggtcgaagtcactgcgtgtgcatgattggcatggatctccaatttgaggcatggtggtggagcaattgatacccatagccaatctcattgactcgaaaggctacaggccagtttctggtcctgctgagctgagcagggcaagcaagaaggagaatgccggatggagaccaaatagggtcgcgtctgggctcagccatgaagattgcgaggcccttcatgctcctgcctccgccagagctcattggcctggacgtccaatttcacggcttgctgtgatgagccttgtgaggggtaggaagggcattcgtaaccactaactagcatcgatctccggtcagcctcgatacctcacctatcgtgtagcggcgacgtaaccgcccccagctgcgggttcaacctcgctctagctctgggtgtgcgcacagccaaatctcggatttaggaggcctgccagtgggcctgccttgagcgaatcttatggcgatgctccaaccgaccgcctttttgcttagaagagctgaaagctgctgcctgctctggagtatcgagtgactgccgagccgccagctggtcatgtccaatattccggtgcctcactgccgggggagctgccctatcagaggatgctgtagtcagcgccgtggccagctagtggtgctggtgttggcgggcaggtggggattggcctgccccccgaggcagcaggtcaggttggttggctggctcgccgtggcgcacccattgtttttcctggtccatgctcttggccttggccattgaaaggctggtcccctggccattggcattgggcgacccggattcctgggagcccttcctgagcttcccagcccaacctagttccagctgcctttcttgggaagtctagttttgggggcgctctattcaatcgcggtggggccatgctaatttacggctcgtccttgctccttgttttggagtacgtagatccctacggggctctcgtggataccagactgctgcctcgttcaagaatggaaggcaattgctgagatgaccaattgtttgaccattccctgctttggtcttgataatgggttgcaagaatcatagtttcttaccaaaaaaattgtacaatacccatgattggtggcttacagattggagcgtgcttcagctggtagtgtatggagtaggccccggtcattacccagattgggtggtttgtgcccggtttgggccctgcctcaagtgcatagctgaatgcaaggtgagcaaagaggctgaaggggggaaaaacaacctcccgtctaatatcaagggaacctcctatcatggatgtagcgacgcccaatatgcactagggccacgcaacagcctcggttggtgggcaagacaagatttgacccctcgctttacgaaactaccccattagttagtgcacgtcgtacgtcgtacacgccagcaatgacctcctcccatcagctgcgagctggccgggctctccacacgctgttcgcaccatggcacaagggcgagagaagcctccgtagctcggtactagctagctgaatcgaccgtctcagttggtctcggtgggagacatggatcatcgctaggcccatagggctgcgccatactgcgcgttcgtatccagttatcgttaggcggctccaggatggcacagcagctcatgcgagactacctacgacacgtgtgacctgttccagcctggaggatttgggttttccgcgtcggtgatgacgcccgtttattgcaacgcgggttttggattcccaaggtgtccctttgcccctagcaggccgcgttaggctgcgtgtggttggcatgagggttagacagatcccgtgtagaacgctggtggaggacgggtctggcatgtacaccgaccggaaatacaccccataaacaattagcctatacagttactagtttggatcaacctcctacgtacgtatctcgttcatttggtagagaggggcatatactcactatgcaatgacacgcaggttaaagagactccggttagcagtagtggctcccgatcggcttcgggatgggtctttggctcccgaccccgcgagggaccagatgctgtagccaagccgatagttgtgtacgtagtagaccaaccgacggggccgctcgatattaccttgtgatgctacctcgatcttatgcgagggacgattgtttttttttggcgcttggtgttgtgttattggtacggtatttttcctttttttgctgcaccctctcctgcgtgggcctcatctgccctatacgatccatgtctcaggatagaacatgcatgggtgaagaagttcctgtcgacggcacagggcagacgtgagatggatccctgttgctccctgcgacgtccatgtctcgctgcagctcataagagcggcaatgctccgcgtggaattcctaatccgtcgccatcttgcgctggccgcacatcagtctttcgtcattcaccgacctacacgaggaaacaggcaggttgctgcgaggaccattacttgcaatggatatgtcagatgaattagcacacactaggcctgcaagaccccgcccggtgcttacaggaggttgccaatacaatgaatgaatggtacattgggagccttgcggggggcgagttggtagaacaacggatccgatagtcacataacagccttgttgcccataatggtggtgcattattgcgccgacgacgccgcgaccccagctagactacctatgcaatggcgcatcgttgcatgccaatcatggcacaagtgcgacgcccctggacggaagcacaaacgtgcagtaacggtgacagggcaaaatatgtacaaggctagccctccggtgatacaacatccaaagtgtattctctgttggccctcgtgtctcgttatcaattgagaggaggagaagagacatggcaaaggccaagaggtagggcgcacttggccttcccccctcttcatgcgggccaccttcgccgagctttccaagaattctggaacatgatgtgcacaacaagtgcctagggggggattttagcagcatgcgatgcacccgcagccccctccctccctgattgacggtggcagtggtggtgatccaatgctagcttgtaggtttcgttcaatggttggtcggcgagtaaccgccatggctggctttcgttgcgctgcatggcatggcgcccaaccaacggaacctgggaaccccactcctggctgttgctggcttgcaggtatgtatgtacattgcccgcgcagcccatgaaacccgttgcgaccggcgatacgcatcggccgaagatctggtctcgggcgcttggacacatgtgggcgagacacctgcgctgtggcgagcagactccgtcggaggcaaacaagccagcagaccaccagacagaggccatcgccgtcatgatggaggtggctggccatgcatctggccgccagcttccctcctgcagctccctggtcgcctcgcccctgacggcgtcccggagcagtggcacatggcaaaatggaacagttctagaatagttctggaagcttgccggaacaggcaggacggcttgagggggtctgatggtgtggatacgccaaacgcatccatacttgggaggtggggtttgacggtgggcgagcttcacctcttccggaatcacattgccttgaacgggatagagagagtaagcttgataccctgctgataggaggggagggaggagaatgccgacctcagctggcagttcctgaggagtcaagcacgcggtgataaaacaggacacacctctcgcgaagggaccaatggccgtgtctctttttcatagcgtattagtggcgagttaccggcaggaatggcttggccaacaggccggccgaccagatagggcggcccactccagggtatgtacatgcccagattcatacgaaaatagctgcatgcgtatatctagcaaccacatcaatggctatgatatcgccagctgggccagtcattgcactgatggcgttccgaagctgccatgtcctggtggtttggcttggcgccccctcaccacacaactgtgccgcacaccggacacactattactagcaccagggaaatcgcccagaatgtggagccgtcagccctaccaaatatctgggtaggctcacttcgaagttggatgaaactcgaacgactgtttttggctgcgtctggagatcgcggccgcgcgcgatggctaataggcagcagcaacaacgtccatctcaaacaggagctacatccttcaaaagggcaattccgcgcctgcgagtggttgagacacggcgggaaacgaaacccgccgaaacctggtcggctcggggatgtaggaggattagaatcataacaagaaatagtactacggctcggttaacccgtcaccaacgaagctctgctggagccacatgctcacatcacttgtctatctctccccgacagccccgggacctacatagcagcaggatatatggcgcgcagcacacacatacagagcaattgtatgagttcgggggattgacggcatgttgatgcacattaataatcgggggacgccaacatacctacctgttccggccagtagtagggctgggtgcagagggacggaatcgcggaggcatgtttgcccaggacccggatggcacgggaggaacacctgggagcatggcagcctgccctcggtcggtatgtactccttctgagaggatccagcagagatgctgtgaacccgcaacgcaggtggataggctggaaacgaacttttgaggcctccacttcccgcggagctgcgccacgatggtggagcaacgcgccgactatcatgtgcgagcacccaaagagaaatggcagtccgtggtaaggtacatggggagcaaggcctcgtcgtgctgaaaaggcggcatcctgagcaacggcaggattttctcgctgcccttccaattccctctcgttccgcgcgagagagtgtgtgtgccagatccatctggagttcgtctcgttcagaccattgcgtcaaccctgcagctctagtgcccttttgggtggccattgctagggctgaagggggctgtgtaagggggttgacgaagcccacgggggagtagcgcgtccgccagggaaaaagggggtgtcctgtctctccttggcggcaccgagtggaatggctgcctgtgtgtctcgctgtttggtgtgtgagtgtttcggaccctcgggaccgtcaccagagtgtctgtccatggccaagggaaggaacacgaagggaagggcacatctcgggcggttttgcacggggtgtgcctatacgtggtggacacgcgggctgtaggtaattccatggcacggcatggacatgccatgcgatactatgccttgccctacctggcctccattttgcaagcaggaaggctcgtctatcttaaattgcatctcgtccaatcgcgggcggccagaacggtggtggccttgtttctctgtgtgtgtgtccgtgtgtgtactatgtacgtgcatgtgcacgatgttaccctactgctcgcctgcattgtggatggcgccctgccatttggaaaccacccgcggataggtacttgataatagttggcgattcatttcgctgccggctacggagatgccccagtccatccaccgccgagctgcatgtctatgtgctccgtactgcgtggccttggaggagagacggaaacagacaggatccgttgtctgttggttcgttctcatacagccatggtcaaactctcacccagtgggtctgcattcctattcttatgtcttctgtcatggcgactatgttgtttgtggctcaggactttcttgttctaatgcccagtaataggctttgggtgagtagtagtagtaattgcgccactgcgacctgcatgcatagcatatatgtaactccatatacgacatcacaactgtgtaggagtgggagacgttgacggggccacatgtgtttgagctgtttttgggtcccccgttccccagaaccagagcaaggatattcccaactgaacaatgagtgaactgaaccccctcctcctccccatcccctgtcccggatgatgattgagggcgagtctgcccttatgtgccgtctccctatcagtgagtctacgacttatagggcaggatgtggcttcagtacgcgtaagacgccgctcctggccgtcgcacatgcggactgaaccccctctttcagggcatatcctctacttacaaggttggggcaaggcagccagcgaagatcgagacatggaaggagagatagtcatggaccagggatcgcagagagaccgagcctgaacgctcaactgaaaccgcccacacgggctggagccggctcccagcaaactccacgacgtacgtacatattatgggcgtgtcttgctcgcggcagttggatatgccagggtgtgcttggggatctggccaggacaggccgtgtggccaactgagccaagcaccggctctatctgggggagggtctctgttgctccgtggttcaagggagggttgtaggcaggattaattaccttcttaccacctgctgcatgttgtaataacaacacgtcatatagatgcatatgcatactgtctggcttatattagtacttcatgtctgagtctgtaagttggcgtgtaatgccgccgaattgagacccatccggcgactgtgtggtgtccccatgcctgtgcttgctgcatacggtatcgacctacacatcacggacagtctcgctcccaaagtacctatgtatcatgttgcgagatatatgcgtctgagaccattgctcgtccagccgcaggtgcatatagaaccacccaacaacacatacatgcacacaggcaacaagtccacaataccaaacagcatgcctgcgagccctgaaaacacagacacgcgcaaatggctctggtggacgagccgtctcccagtcgcagtttatgcatctatctgcatgttagccccggcccagggttgagattcgaatacatacatatgcgcgcgcatggagctttggccgccacatgacagccatcgcgatgtcaccccatcattccaggagccgaagtgctcattctttgaccgttacaccctgggtatccgtgtgagaaacgtacgttgcatcgcccatcccctcgtcgcaagacagtctcatgtagagtggcccagcctggtagggctagactctgccacccctcatgaggcttaaaagggtccattgcctgccagctccagagaccagtgacagttcgtgatgcagtcgaaacccaggtaggaaatctgtctgtgaactagcactgctacctctctgccggcctgtcgctattcgatcgccaggtgccctgccttgcggaaccggggccaggaccaaaaccaagaccacggccaaggacccagcatccaatactactgtaaccatgcggatctcccctttcggcacttccgacacatgctgtgaagtcattcgcaaaaagttttaaaccgcgcccccctgtctcatcatcccgcccatcctctctttcgtcctactcttacaggtggatgaggtgagaggcagcaggcaccgagataaaaaagcagggaggcaagggcaatgaaccgaaaagcgttcgtctctgttaccgacatggggacacacagaccgcttacgtttgtgtctcccggctgacgcagggcgatatccttgccgccctctccagcttattccctccttctataagctttctggaaggaaaaaagggctcatttcggcgtaatgtctgcttgcccaatgccgctagaagtcaattgctctgccgtgagcgcggcatcagaccgtatccctgatccatgccgtcaatgcttagcttacgcacgttttggctagggacggggacgggaacgggggaggtaacacggttggtctgaagccgatggtgatcgtgggagtcttattcccaagatggctgctggctaaggattattctcctgttccctcttgatgttggtcgctgttctgtccagacggagcgacctgcgcgtgaggcccattcatttaatggattcaccgcctggccctggtcgggctctccgactcgaccagacccgattggtagtgtaggaaggattttcaccactcccgtctcgtctcaacagcctccaagatgcccacaggaactctcgtttagctttccagtgacgtggtgtgccctacgggtgctaattttgatagcatacctctcttagctccgcagtagatcctgatcctcctccatcaccacaaggcgtaacaggaaaacttcccgtaaaacggggcctcgcttcatgtgtactcagaaacgggatacgactcgcccattattcgtgtcttcacgagaaatccagtcctatattgcgttagtatatgctttcgtatgtcatcaccgacctcggtaaatcctgtgaagatctcgtagtgatgttccaggccacatatcgcaaagatattcgctcactggaataacgggctaactccttttcccccgtgtttgaccagagtaatcttccccggcacaatgtcagctcacagaaacaatggttagtcctgaatgtagaattgtgtgtgtagcagtggccctagtggtcatgactcgggaccgagttgcgtcgacttcagagtttttatctgaaggatctcccaatggatgtccaagcactgcttcaagctccacgcctgactcgtgaactagcatctccatcaatgccaccagttccatcgcgtgacggtggcgaatgaaagaccctctcttagatcggaattccgcaatagctctcaaccgttggagctcaagtaaaactatttgctcggccttgacagtagcctatgcgagtgcgagcagcacgtcgacgtagagtagaccaacatgcttcggcactgtgaagacaagagtaaagttcaaggacgtttgtagaaaagccggaaagaccaagtgtcgggcctcaaggcctaagttgcagaggccaccattgtaagaactctcatcgcatcaacaccatttaaccctctcactacgtgttctttctccctagagtaacgacgtgaccccttctattatgtttagtctgtaaacaatcgggttagttactgaaccggctttcttggagccaatatctaccatcagatcactcgcggtcttcatgtacttctctcgtgtttattaaagggtcaaagttgtgcagaggcttcaagtcaggcccatgaagatgaaagggctatcacggaaagcccaacggcagaatcagcctaggatgaatgatcagacatctttgagcttagttgcgtcttggtatggtaccatccagaagattcgtcaacctatttaattatcacatcctaacgacaagaatatgccaccaacgttcatcgaaggacacctagtgatgagatacctacattagacatgttctggggcttagctgaacccaaaagatatagctctagttgcaatctgtctcatggttccgttcctgaagcgtagccttttatcacgagtccatttgctactgatctcagacactccttcataacagacttgacggccaatattattaatcgtcaatatccaaccccatttatatgcacaaggtagtgttccgacatgtaattatgggcaggtttaaactcaattcatcctgtagaacctcacggcatgggtagtaagtacgccagggcgtctttgtattctgacatcacatcatacctacacaaccacaaagaaagtacctggaccaaagataacaaaatggttagttatttgctcaatattgtcactagacgaatacttggcacactatttgcatatttgatgcgacgccgcgccttggtgtacagccgtccgatgtgacctacccgagaggccatcaagttgaacagtagccatcgcgttcacttgggggctcaacgaatgtctcatcaatagatggttaattagattgctattcagtaccaaaattcatatagtctcgatagataccaccaatcgaagtttgattggggaatttgatagacgaagtattgcggaaacaagttgttgtgtcagaatgaatgtctccgacaagctaaagaatggattcatagtatcaagatggccgacgagtctaatatacatgattcccaactatattcgcattcaaacatacttaatttgcaattgaggggctcgtctgacattcgagacgtttgagacagtcagtgcccagattcatcggcggcaacataggggcaatacattgccctctggataagtcgagttcctgagcacaatgtaggcaggtatgggcatgatgtagataggtttagtaagatgggattgtgcatgttttgttaggttgcatacttgcagctctgtggatgtcgggaactggtctacaacttgacatgaagatggcaatcacggtccagcttcttatcaaagtgaaaatatgtttcgactccaaggtgcttctggttcatgccactgcgtagcagatgccttcccttattttttttttctttaaatgcaacaaatgtcactccaatgagctcaacctagcttctagacgacttaataagtagtgctaggtgcggaagttcggaaaacagggaagacacgtacttgaaattgaagatgtttattcggactttagtagaacctacaaggggtaacgtatttcaacattcggcctttaggacgagcgagcttaagaaactcatagagggtataggagtacgctattcgctatatatgcacagaatgccccgatcgttcttgtaccctatttacacagccgtgggatagaggaaacgagacatcagactgaagggtgtttatgagtagattatttataataatgactaggctaatacggcagtatgatatgctatgaaccgacagtctgtagtttagtatctcttaagttttcatcattgcccttcaataatcgtggaatactcgagtgccaaattcaatgtcacccggctgtcactgtagttaaatggaggagtttgacagcttttccaagggactcaaagtttcaatcaaattcgcaagctctgtatcgacttcaagagacccctagaccaatctcctggctagtagctgcagtagctcgtctgtcttgatgcggcgcgagttactattagggctagccctctctttcaacttcttcttgtcccctctgcatgttgaactcttcaagataagcggcctaagcccttatagatatatggagtatcgttctggcgcacagttcatgcatcctacctcactattgacgggtaatgtgccggctcccgtgctaactaacccaactctctcctgttgctaagaatgaagtccctggaggtccacagtaagacccttgccacatgccgtgtggcatgagtctagtaatatccaactccgcgtatgagaatgtgacacgtctggactcctgggtgggacagagaaccaacatacaccgtatagtcacccctacacccaagagacctcgacgctagcctatccccgagcgtatactaagcagaagacttaagatggagcgtgtgagtggttctagtaacgttccagtgacctctgataactcaatggtaacagcacacagttgaggccaagactgcccaccagactaatgatactggactaatgggaatactcggctacaaaatcgcagtcccactgacttgagaggattcatttgactctacttagaccggtatgctcggccgtaaacgggctgaactcaaaaggaacggcagagaacttgccgttgcagccgagtgcggttattctaggcggcggttgaggaggtggagtgtcacaacgtggttctcgagttacggctattcaattatggcactgattgttaggaccacaatcggaggggctacgagggttttagaactgtagctgtaggtatttgttgaaggaagtttacgcggctactggaatgggacgagagccaccgcgtaagatgatggaatacactgctgtaattagatgaacaagaagcaaagaagaaccctgtgagttactcgtcctaagattgaagccattgtacatatatcatgaaagataattgtcaccagctctggtgatgatggtgaaatcgtgaacgaatcgaaaccaagagatattagcaccaggaacagccatcaatcaatcataccaaactgcaggcagtggagccctattgagcagtaaggtctagaaccttgggtcggtaactaattgtaaactgaatgcgcccatttgattaacttgcccagtggcacgattggagagtctagaagcgccaagaaggaactgccaagcagctgccgaagggcctgaattgcatttctttggctcggggaagaaccaggtttcctcaagtggagagatgagacgctggtggctcttgcatcatttggctccaccggcggaacgtggccacactattggccagtagttccggatcatccttgatccgaacccagcgaatgttgctgcgccaccacatacttcatcgtaactggatccaatctgcgcaaggtggaaggtgggagccggcaactgggagctggggttgagccgagcagggaaccagtggttgatgtgggcagttcagccgtgaagcgaaggcgacaactgccacatgcgttgcatcccgtggccaggggcacacgtgtgtccagccaaacccatcagccagaacgctggcgaatacatgtgttaaagagacaggcaggtaacattatcacacacgacacatgtcttctatgtaaactcttgtcagctcttgtctcgattcgcgtacttgcgggtgacgtatggttgttgcagtcaagtgctagctaccgctttcttttcttctctcacctgtgaacataggcaatggcgatcatgcatgttgtttgaggagcagtgcttcttgtcatgcatctgcccagtacttcttccccccttcccaactgtccatatgtacgtagcagtcagctcggaacaaatttgccgggcaactacaagatggcgtaacacctgcccactgaatatcgtgagaacgcgcgctacgtgcgtatgtctactcgcatgtgcgtagttacccagctacctaccaccagtgcaacggctcgcacttattgacggaatgtgcaacggatttaatgcgagccggctgcttactgtgtagtaagctttgttgagtccctggtgcctgatgaaccgagactcaaacttcaaggggttgcagaccgtggagccgcggccgcggccccattggacatgcgtcagctatctgagtgtcaagatacagcgagcactggacctcgcagacttggtgtagaggctctgtagatggcattaaccatctggccgcctacccacgtaatagcaggcatgttgtgctgcagttcttcgtcaacgggaggaagattagcgctgcgacaaccggtttgaggcccaattgtagtttcccagcactggcatgagtgtgccgtacagccgggccttgaactctctggcagcccttctgcccacccacatggccactctgatagcctttgacgtgccgttcgttccgtgggccaaggcccctgctaaaccacccgtccgctgccctttgcaccagtcggagtgtacgtgcagtcagattgggcatagagctccgtcgcatttgttggttggtgccggagaccgagcgatggactgaccgatacccactgcctgagacaaggccttttgctgcttgcgcagagctgcatctgcggccgactatccgttcatcagggcgcgtataggcgattatgtatgttttgtgcattgtagtccacagcccgctggccgactttgccgtgcccagcacttgtttcggggagtgtgaggggaagctaatggaagccaggaacctggggtctgggaggggagagagaggcctcaatgacagcgggacagtccaggtgtcattttcggactgtgcaggaacctgaatcttgacagtgcagctagcgcgtgggtacagaccagccggtacgtggccaagcgtcactgaagttgcccgagtgcgactcgagcctatatagtatgagattgataggcttgctatgtcttacctgcccaatagagtggcaacggccgtacttctcggacaatttcttccattgggcatcttgaatacgttgaccggctagagcgagaggaaaaaggatggatcatcatgcaattcagctcatcgtcgacagctctggaggtaggccctgtgccgacttccactagtcgaagccttggccggtacttgcacagtgcgcggagtttcattttccttggtccgcttggacccgatcgtgggtgagtgctggcgtgcaggcagggcagcttaggagcattccgccagcgatatagcgaccttccactgtaaattttgcaatccaggcgctaaatggccggctgccccctcttacctgttctggcccacgcccccaatgccttgatgatctgacccttcctcatcgtctgtacggtctccctttggcactcttcctctccatcgccgacctccccccccagcgacgccgtcactcctcgccgcctcaccattgtctacgactgcatcaagtgcagcacatttctctcgttggcacatccagcggggggcttcgacgctggctgcgattgcggagcgcccgtgccctcagcgacggcgacggcgacggcgacgcaattaaacctccagtaggaggcggatctgaacttcgaaatagtcaacgctgggcaccccagcaccccagagccccttcgatggcgcacgacgaaaagaaatccacggcggttgagtcgaccgaagccgcgacggccaaggcagcttctccaacccaagcgccgcaacaaacgacgacttcagtgtcaagcgacgaccacgacgatcaatctgtgaggataacccgcgccaccgcatctcgcaaggttcaatctcttggacctgtggcatttcccatacaattgcaatgtagctaattcagggttgtcgcaatttttgcagatgcactcttacgacgatgacgacttttattcagaacacgatggcgactaccccccgagggcccgccaagaccttcatgtcaccgaagacgatatcctcgaagcccaagcgctttcagaaaagctttcgctcgaggaagtgcgcgacattatgacgcgtatctacaagacccacgaacgagatcccaacttcccgattgtggtgttgaccaagatcaagacattcttagataacgagcaattgttcaaggagaatgaaaacaatgagaaacagagccccgataacgaactgcttatccgtcagatgaaactcgaggcagctcttctcacgacgaatagtccatacgccgaagtccgcgccgttgtcgataacaaggatgatgtcaacgcgccctgttctactctccgtagttgggccattggtcttatcttctccttgatcctggcgttcgtcaaccaactgttcgatattcgccagcctaccattcgagtgatggcaaatgttgcgcagcttcttgcctatccgttgggtaaagcctgtgagaattggcttccagacaagggcttcactctcttcggcgttcgacacactctcaacccgggcccattccacaaaaaggagcacatgctgattacgatcatggcaaatgttgcctacaacaccccgtatacgaactacatcatttgggtgcaatatttgccccagtatttcaaccaaccgtatgcgtctcatcctggttatcagatcctgatcgcgctcagcacgaacttcatcggatacggcatggctggtatctgccgacgtttcatcgtctacccttcgtattgtgtgtggccagcatctctcgtcacgattgccttgaactcggccttccacaattcagacaacacccctgtgcaaggcccactgggaagcatttggcgcatctcgcgcatcaagttcttctacctcatgtttgccgccatgtttgtctggttctggttcccgggctacatctggactggcctgtccaagttcagctggatgagctggattgacccagataatgtcaatctgaacgcaatcgttggtttcaacaatggtttgggtatcaaccctttccccacattggattggaacacattgctttgggattcttccgatcctctcatggtcccgttcttcagcaccatcaatcgtttcctcggcgccttcatctcgatgtgggttgttgtgggtatttggtatagcaacgtgtttgacacgggctacctacctattaactcaaaccgtgtatacgaccactttggcaatctctacaacgtcacaaaggctaccaatgcaaaaggtctttttgacggccaaaagtacgatgcttactcgcccccattcctcagtgccggcaatgtcactgtctatcttttcttcttcagtgtctacacctctaccttgacttatgctgtcttgtatcaccggcatgaactggtcactggtttcaagggccttttcagtggtttccggcgcaataagaaaacaagccatgacgaccagatcctcgacgttcaccatcgtctgatgaaatcatacaaggaggttcctgagtggtggtacatggcctgtctagtaatcgccattgcctttggtgttgccggcatcgcaacctgggagacgaacaccacccccggcgttgtcttttacggtctggcactgtgtcttgtttttgtcattcccgttggcattatcaaggctatgactggtatcgaagttacacttaacgttctcgctgagtttattggaggttctttcgttgagggaaatgccctagccatgaactttttcaagtcttttggctatgtgacgtgtgctcacgcagtttggttctccaatgacatgaagcttgcacactacgtcaagatcccccctcgtcagactttcttcgcccagatggtggctacctttgttggtacccttgtttgcgtcggtgttctcaacttccagatgaggcacattgatggtgtttgcacaccagacgcgcaattccgactcacctgccctggagtgaacacattcttcactgcatccgtcctctggggtactgttgggccaaccaagatttggggtaaaaacgggcagtacaccgagactttgatcgggttccccctcggagttgtcgttgtcgtcttcttttggttgctttctaagaagtttcccaagtcaacttggttgaggcagattcaccctgtggctatgatgtatggtggaatcgtctgggcaccttacaacatgtcatacatctggccctcggttcctattgcctttttctcgtggatctacctcaagtcacgctttcttggtttgtggtccaaggtacgttttgtgattccatgtctcgcatcttgtggtatatgtaactcacctgttctactctagtacaacttcgttctctcggctgcatggtcttgcggcattgccatctctggtatcctcatcttcttcaccttacaatggacgagcacagagttcgaatggtggggcaacaacgtgccgtatgacggctgtgaaggcacggcttgccctctcaagacattgggacccgatgaatactttggcccccggataggacagtttcacgggtgatcatcaccttccacccctttgacgttctccaaactttcaccttttcatcatcctccatcatcatgcgtgctatatttatcaggagttaagctatactggtcatactggggtcatatgttactgtgtttatccaaatcggcgaagggatggaacggggtgttttcttatattgttccgcgatttgcactgggtatatcgggtctctctggttgagaatcaatgggtttgcttgcttgcttgtttccatcacatgatcttttctgttcgaccgtcctccgcccgaccccctcgccctattctacttttattgtttattcatgctcggctcttgagccagtctattgggacgagggtatgcccggaattacgtgtctcaccaagttccactttttctttgaccttgaatcttcccaaagtgggccttacatagatggataagaattggatcgtcattggtcaaactacgtgtgtcttaaaaactacgtgtgttgcctttgccttgatgtcgaataagatgtgttgttcgtttatagagttggagttgctggcttgatttagtaggggctttttaaaacaagcagtttatagaaaaacgtttcacgagagagcaagggtcggcacagcaagtctttaaacaaacaaaagaataaatcattcacccctgaacgcctgctgcgtttgtatctatctagcccatgtggtttaaagacgagaagcagaaaaaaaatacatgatatgtttgaccagataaagtacaaccagacagaaaaaaaaagggtaaaaaccaaaagaaactcataagtttatcaatatccccaagcaaataatccaaaagtaaaaaaaaaaaaccaccccctttgaagaaaatgaagaataaaacaagatagaagaaataagaaaatatgaaaatgtgatgctgtatatggcaatgaaagagactgaggtctcggggtatatatataattgtccatccagtgtcatcatgctttgaatcatatattttttttgcataatatcgtgatgcgaattttagttggccaaccaggccggcccgagaggcgagacgggactcgtggggtcggtgttatccgagtccatgcttctcctcttgggcggcatggcactcattgggctcaccgccatctcctgggggaattcgcgagcgaaggcaggcgacggagcggccggggagaacggcacgtggtggccggctggcggtggttgaagatcatggggcggaggagcgaacgaaggtgttgagatggcaccgctgccgcccctggcgatctcagctgcgcggggaggcagctcaatcgccacaggctcgctgatcactagtgagctcttgtgagactcgatgctgcccccggaggtcttgtgcttgtgttggcgaaggccgcgaagcttgccgcccagagtcttgcggatcgactttgtattctccgcatctctaatcgttggttttccagggccgtatggagcaggagatgggggcacagagccaggaccagggccagggataggcccaggtgtaggagggggagcagcagagatagaagcatggctcgaaggaccagagctcatcgaaccggtgctcttatgacgactagagagcgctgatgccgagatactaccccagctcagatgacccttcttcttgacgattccagagacaatgccttcgtcggcaagtttctttacaataaagtcgtactgcatagacatggttgggttttcagtgatgtcacatgcgtacaggtatactctgtgcaagcccttgatgggttgcttcgagaactcgtcgttgagacgctcagccatagcttgggcagggagtactgacccccagaggtcaaagaagtttgctcggtgtacatgatcgctaggaacgccgagagcctgggggttcaatacctcagtccacacggagaagatgagagactgcaggatcttgcggtcatcatttggtaatgactgatatgacttatcaggtctggggaggggccatggtgtgctcattgggatcttcgcttgagagtgcagcaggtcaaatgaggactgaatcattggtgtctcaatggtatcatagtttgtgactgattcaacagcatacaagagaacccgtaggacatcctccgcaacgtcggtggggattcggctctcggagtacttgatatccagggtgacagtttgaggcccgtccatagtcgagactacgagaatatcagggatatcctgcatgcccgctttggagatggtgtgggtgaacgtcgtatcgcccatgtttagcgtagttgaaccatccactggtgcctgggggcgatgatgcacgaccgtactgaaattggtccagtagggccaatcggtacagcgctggacaagctccaagatcccgaggccttcgtggggtcggctcgtgactctttgctcctggatggggcggaggaactcgaggggtgtcaactgatccacggagaactggatgcggactggaataatgtttgtagtcggcgcgatcaaagaagccatatcaaagcgatctggcagtgggatgttggcaccctgggtaacctcaccaaagacgacatcgctagtcgcagagaactgagccaacgtgatggcccatgcagccttcaggatggtattgaaattgagaccaaactcagaaacagggtcgacttggattgtttgggagacggacatgatgtcgccggcaggtgggtaaggcttttcgtgagcaacaaagtgcgtcatctgggcgccctccagcttgtccttccaaaacgcaacgctggcctcgctgttaacagcctgggcagctctcatgtagtcgaagaagttggacttgtccgagagagtggccgagccctcgtacaaagcagctagatcctgtaccaagatcgacattgcctgttcgtcgatctgcgagctacttaggcgaacgataagggtgctctgtgctccggcatcgaggaaagtaaacttggtaacaggctcttcaggtctgaacgttgaatcttggtcttcggcaacaacgttggctgtgacactctcaagacaccatgctgggcaaggataacgctggaattcgggcctaaagttaccaaggtggacctggtagacaacacgattgtggacggcaaacgcagtgcggaaagctgggtgaagctgggtcagcgtctcacatgcggtctggagcttctggacacggattgggccattgaagttaaagatcaggcactgcatgccacccttcttgctgtacatccgggtttccagtgctcgcacttgatgtgccgacgcctcggtaatgtccaagatgtcatgacggcgaactctcattttcggggcgatgttttctttgatgaacttctcctcaaatcctggaatgttgaagccgccctcagtcattgtggctggtcggatttcggaatgaacacgctcgttaaaggtgatctctgacgtcgcgatcgcctggcagatctcagtcaaagtattacctctaagtacatcgaggaggtaaattgtaaggtgtgactttctgcactggatcaccagctttccagccaggaatctatcgccaccaagtccaatgaagctgtcattgctcttgatcttggaaggctggatatccagtacgttagcccaaacatgacgcatcctctcctcaacgtgtgtcagaggtagaggcttgtcctcctcttctgaatcagggttcgtggaaactccaatcaactcggtgtaagtcatacccaagaccttcttagccaacttgcgtctgttcaccttcatcgaggttgacattgggaactgcttcagagggatgaatgttgacgggatttggtcagaagtgatagctctgatcttgccactgccctttgacgaactatcgtgaagggctctgagtagttgtgtcctctcgcgtgtcttcgtgcgcagcttctctagttctttggcattgtgctcaaggtcatatccgacttccaggaatgcagccagaatttggaccgcgtcacgagtgaccaccgactcaactacaacgtcgacttttccaccgaggtagcggcgaaggtgatactcaatctcgccgaccggaagctgtgagccatccagtgtttgctcctcgtacattgaggatatgaattgaatactgccatcatcaagataacgaacaaggtggccagtcttgagataacgattgcggctcggcttctccgtagtcagtgcaactggagcaacaacagtcttgtcaggaatatatgtatgtggtgtcaggagggggcagtcgatggccagttcaccaacagcgccgatcggcatcatcttcttggagtcttctgggttcagaatccaaaactttccaatgagaggtggggggataacggagctgtcggtggaaccagtaacttcagcaatggaaatgccgagagggcagatttcggttgcaccatatgccagcatgatgtttcgacttgatccccagaagttgtacatgtcatcgtcaagtttcctagttcggaagcagagagtcttcaggcgaggaagataagcgggatcgaggcggcgagcgagagtagccgtcatgtacgaccaagtgatgttcattcgggccatcacaccaccaaggtcctcgaggcgatccttgccagatgggatgcaaacacagcctccatgaaccatagtgcctagaatttctacaagcgcaatgtcctggctaaaagaagagagctgcaagacacgactgtccttgctcattctgagtgccgggccctgtgccatgaaagtcgaggcgagagaagcgtgtgtgaagaacaagcttctcacagctgaaactctcgcctttccgggggtaaatatgatgacagcgccatggtcaggggtaggctccgagagggcgggaattgagacctgaggagggagaatggagaagaatcgttcattaacgatgacaagatttggcacgatgcacaccagatcattcaaagcggagtcggtagcaagaacaatctgaggctgaagatgcttgattgtaaactctgctgctgccttgtcctgagcgtcgagagcgatgatgctgccaccagccttgaggactgcaagcatgatgacgggtgcccactggctcttttccaataccataggcacagcaagaccagggaccacaccaatgtttcgaagatgagtggctagggttgatacgcagtatgtcatttgatggtaggtcatgtggccatcccatgcagcaattgctggcgcattgggccttgtttgcgcatggcggtagatgagggtatgaaggcagttgtttgtcttctcctcccgcggtttgaattcgtattcattcaccagaagctgtgaatggtccctttctgtgaaaagatcaatgttgtccacagtttggtttgaatcctcaagaatgagtttgacagccttctcaaaagtgttcacaactgtttcggcctgggcgacggtcatgctcctgaacgtaaagtcgatatggagattatcaccaataaacatggtagacatggagacatcacagcccgagctgcgggatgaagtcatcaggctggccatgaagctagtgctgtcaagctcgggcttgtggtgacgagcattatcaaagtctcggagcgacaagcacgtgttgaagagatcttgagaggtgagcccggtggcatggtgaatctcagacatgttagggttgtcattccgtcttgcgattgctgcgatctctgcgaacgacttgaggcactcgataatcttgcgctgaggtagcaactcaacagtgcagggcaagagagaagcaaaactgccgatcgctttcttcatcccatgcaagttgttctcgtcccggcccgcgacttcgaatccaaaagaaacgtggtccattccgacgtacgcgcgtaggacaagcgcccaagcaagctgaagaacgtaagcgggttggatctcccgtgctatacagaaggtgtgaatgtcatgacgttccactttcaagggcaggaaaatggactggcgttcaaccttggaaggaggttttcgcataagcactgggaaagtgcaaggtcgaacatgtgcgagggtggagcgccactcgtggagactgtgtgatagatccatggtggttgcgttgaagagatatgtgtgaagaaggaggccgtcttcagagacttcctcgcccgataatagctctcttactctggtgatgatgttgtcaatggaggttgcgtcaatgacggcctggctagcatcaatcctgacgtaggtcctctggttcgacttgcacaccgacaaacgatgacggggctggccaggagtcaccttcatagaaggcagagcagcgagggtttccactggcctgtcgctgtctaggaaaagcatctctggcgaaaccctcttgagcaccacttggtcaaagagaccatcctctgagatgctgtcaatgaagacactgcgcatggatgaatgggctgcgaccacagttgtccaagccgcacaaagcctctcctggctcacaggctttctgtcccgtgtgttgagctcatacagggaatggcaatagaagctgtcagggtcttggccttggctaatgaggatttcctgctggttggggctcacagggcagattgtctcgatctctcccacatcattgagccccatctgttccagccgctcgctagccaattttgtcagaccttcataagtgacattcagcagcggcgcatccgctcgagtcaacgttggccccatggtactcaacatcccaatggcttcatgcacgcaagattcaaacgtctgtagccattggatgatgcggtcctggcgctttggtgaaacatatcgcacatcaacgattgtaccactatcttcaattgagacttgaaattcgtacagggcaaggcggccaacatcctgaccaacatcagagttgacagatcccaaaggtcgtcctggggcgctggctggccgaaggagactgccctcatagctgatcctgttccatgtatcgacgcagttgaacaggatttccacgggagtcgtcgtgaatggctgggatggggttaagaactcagtgttgaagaaaccaatacccaggttggggatcagtctccgggtatccttcatcagcttcaagagctccatcacatcggcgccagagtctacattgagatgaaccgggcaaagcgatgtgaaccagccgacagtttgatcgatgttgaagtcagggttcctcgagtcgcgtccgtgctcctgagtccacatcgtagggacatctcggtctgggaaggttcgacggaaggaaaggagcaaggcagttaagaagacatcggcaggctcagtacggaagatgctgtcgcaggtttcctgcagtatccgagtagtctcagcgtcgagactgaagctgaattgcttcgatctgccgtatgtgttgtccgagagatccaggtcccagtatcccaagctaggcggcagcacttcgaaaggaagtgtgggctgggtgagcctgtggctggactcatagccctggtattcgatccagttggagaagggaatggaggggttggacatgacgattccttcgcgaagaagttcgtccagatcagataccaaagtgcgccaggatgcacgatccacagccaagtgatgcgcaaccaagaagagatactgctggtggtcagaggtggtgatgtaatcggcagagaaaatgggacctataatggggttgattgactggactgctctctcgatgatggcatccaaatcattctcgttgcgaatcttacggctcttgtaccggaacatatccacgttggactctgacaagatgacctgcgcccagccttcagcagtaaggcggaatcgagagcggagcatagaatgcctgtcaaccagagctgtgatggcattttggggggtgatcgacttggagctcgacttcatctccagaagaatgctctgactgtatttgtagcccgacgtagtaatggagttggggtcgggattcaggttcatggatgtgcggaagaatagctgctgcatggccgacagaggaaagaactcgacattgtccaggctctcgccggccatgagctcctggccctcaaccatgccagactcatcctcaatccacatggagaaggtcttgagcgggcgggtggtggagagtctgttctggagcagaacagagctcttcctgtcgagcttcttctttgactggtagacggagtgccgcgcgtgctgctgaggcggctcgcgatactgctgcacgtgcgactcagctggggggctggcggggagctccagcggctccagcggtggctcgagccctaggccaaagttaggcgccagtcccggcactggctcatcgggcagcgggtacgccttgggcggcttgagaatcgacttgggcttcttgggcgtcggggtcggctccggcacctcgatgatggcggagtggcggaggacgagggagggcggatagctggacttgttgcgagtgtgcgatgctgctggtccgggcagcgggtgcttgggcggtggcaggcgctgctgctgcgactgtcgcggctgctgctgctgttgtggtgggggccccgttggtggagcgtatgtctggcggttcctggatgatggctctgcactattttcggcatgtggcacgctcctctggccgtccgacttctgcccaggcgccgccgcaacgctctgcggagggcttgcccgtctcgagctgctctgcgaacctggagccgagctcggcgcagcctggcccaggatggtctggaagttccggatgcggtcctgctcggcgtccgccaggttccgcagccaccactgcagcgcgcgcagggccgggtttccgttcttcttgaggaccattgcgtgcacgggaatccatagatctggtgctggagactcggctccccactcgcgaagggccatgctaatccgcctgatgcgctcctcgatcaccttgagctgatctgccaccggcaggtagaagcccttcgcttcgctgacgggctccgtcttgttgctcacaaaggccaccaggttgttcttgaaggggccggctgcgaccctcaacaggcagtagtggtctcctctcgccgccatgctgagaaatccctccagatcctgcatgagccggtcctctgccgtcgcctcaccgtctttggtggctgctgctgggtttggctcttcgatgacctcctcgaccaccttggccggttcccgagctgggaccgattcgccgggcccctggagggccttctgttccggtagcgctccatatacggacggcaggctgtagactgacgctgacggcccgtggaatcccttcggggcatagactgacggaacaccgccgtagattgactgcgcaccgtaaatggacgaagacgccgactgcccatgcgccggggacccgttgctcctcgtgtccatgggcatggccatcggcatgacggggggtccattataccctgccgttgggctgaggacctgttccacggatcgggcgtgtgtctgcagctcggcgatggttctgcatcggaagacgtcgtcggcggatacggcaataccaagctgcttcaggcgcccctccagctggaaagcagatgagatgtttcctcctagctccacaaacgagtcgaagagcgggatctgttctcggtcgatgttgagtgtttgcgcaatctccgtcagaacgatgtcggggatctgctgcttggcggcagaggccgaatacttgcccacggccttctcctgcgccattgtagcttgttttctgtcgcgcttctaaattaacaatgttttacaaatcacgggtccaggcagactccagaggctgcgtcttggttacagagccgccagcatgctccggtgtcaagaaacccaatcaactgctccctatctcgtcgataatgcggtgtgtctcgtgggcggtgtgttggccgttggtagctgggtatcggtaagggaatgcggatgcgacagagagacagatgcaagaaagtaaggaaagaacagattagaatcaattaaacgcgcaaaaagtgtagaaagaggacagaaaccaaatggaaggcggccgagtcggatcttggacatgaatatactgcccgcccgtagtaatactggtggtcccgtcgtgacaagggtctacgctgccgtaaggatgtgtatgacataaggccagaaatagcaattactaggtctgttcgggcatgagacacgatccacctctggagaacagtcaatgcaccgcacctggttggaggggcagagatacagcagcagaaccgatccctggctgctgggccagttggtatgtcgtaagacggccaacaatgcccttgctggtagcgcccatctcttttccctgcaggcaattagaggcgcgctgggctttggtggagggcagccagaccgacactacctatacctacctaacactgcccgaggacagagctgagccaaatatagaaaacgctgacggcggtcaaggcgctaaccagcacttcacatcagccattctccagctgaagacttggacagacgctcgcctccatcgcgactgactgccgagcctgatggcaaacacctacactgcctaggaatgacaccttgctcatcaggatgcggcgcatgcaagagcagccgcatggcatgatgcgacgcacggttcggaaatggagtgcatgccgctgtgtgctctggtaggggctggctaaaaccggcgcccagcacccgaataattaggtgcaattgagggaagcacatgcatgaaggattcaggcccattctaccagtccatttttgtgcttccctcctgcgccaggcagcgggcccttcacccattaccaccaccacataccacgacagcgtgtttcatgatattagggaggggcatcataaattaaaccgttgctcgtcatcttcctacgtaccctcgagcctcgatcacggcgggtggattcccggaggccccccagaagcgtgctaacttcttacgcccaagcacaaaagtaattgccgtccacccatgccagggcccaggtggaaatgtctcgccctgctctcagctggatctgcaacgggtgtcaaatttggaaacagagagctgacgcctcgcttgagtttggattgttgcagtgatagccacttgctagccttttcactgcctaacctattcgctactaatttcgtgcacgagaccaaccagcaatggcaacacttgccagagatattatgctccagccaatggtatgttaaatacacacacatctttaatgcaatgccatcgctagctgattggtaagacactctacaccatgtcctctagctctcttaccgggctgtgcaggcacctctcttactactctctatgcctgtggaggctaaagagctgaaagacatgccgctgttacacatcatgatgtaaggtaatagttccacaggcgctcattccaagtcagccgttagtaccacggcagccaggccatgggttcggtattgacaactttgatgctatccccgaagaggcacctatccctggttcacctgtttacctgccctaaagaaatacaacctggaacaacaatttcaacgagcaaggtgataagagagatcagacggggatctccccaaccgcggaatgatcggtagtacttactgtaaggcagaggaaggaagcctggccgcgcgcgatcacccgtctgaccaacgctatttttgctcttacggtattacccttgccggctatgatgcgcaaaggagcgagctgcaaactcgccgggttgcatacataagcgacttcccccaccaccccgatgccttcgatgacgctgcgtttccatccctcgacggaactgcttgtgaacttctgtctagatcaatcatcgtgaccacgatgcagcttctgttctcacaaattaccccagagtttcagaatttaggttttgcctcctcgtggccattccattccattccttagtgggaggcagaagttctcccgatcgaaataagattatctgccgtccttacaatatatccctctatccatgtaaaatatatatacctatgccatagtcttccgccacgaaacctcgtaatccctcgtgttcttctctccatgtcctgtttcaacggccctctcgacaataatagcaccaatagggcagaggccccaaatgtgaaacagatgcagccttacccaaaatcctccaccacatgccgcgccgccccccagccgcgagttgcagattttccggtccaagccaagcccaggcggatgggtgggatgccaccttgtcctacgtcaggccacacacacacgccaaccaacccgcttccctcacagaggggggaggattgcgatggcccggctgcgaccgtgccatccctccggacaagctgagggaggcttttttttaccgtctggcagttctcgggggccccaaaccatgtggtgtaatgtgctgttgtggtcggagcttatctgttccctagtgcatgcttgacagtgtcacgaggctttcgccatgccacgatctgtttatagtcccccgtgtcagcaaaaagaaaagccagcagactcgggagggcgtgtgagccagtagcttcgtcgtacccgtagatatacaccgacatagagcgccaacacgatggcaaagaaaatccggacgagcatttccccactccttggctcaaacacctctattgaagaaaaaaaaaacccacgatgtgttcgctaaaaaaggacggatgagctggatgcagctcaatcaccaggcacaacccgctccgaggataggcgccaagagaagagacgacaactacgatgtgaacagagcgcggatttgggctgtgctattttctatctccggctgtcctgatggtgggagggcggtcacgcgagggtagtcccaagtggtatagggtatgtcatcatttagggaagggtctcgagccgcttatctgataatagcaaccttgggaaaccctcccttgcaccattactatgttggacgacctcgatgtacatatattacactgcattttctaagccagtactactagaaattgcattctcgctcttccatccaagggcggggttgaaagccctcattcgcctacatcttgacatatcgtaagggtaggctgtgtgtcctgtgcctcgctgtaactcgcctggatctcaaacaactacctcgtcctcatctgggtcctcaatgctagtcctcctctttgcctctattacctggggtgggtgagacgcgctgctgtcattctcaaccccgatagcaaggccctgtgccttggtatcatcctcctctgcatgcttctccttctcgctcttggcaccaaatggccagagcccacttaaccctcggcttccttccttggctgggttaacagctagtggtttgaggaccagattctctgggctgtcgttattagctttctcatccccggccattgcaaaatctccaaattcttcgtcgtcatcatggtcattttcatcgtcggagtccttgaagtcatcgttgccctgccgccgtacaacccctctccaccacgcacctcgaccactgtctcctaaggtgtcttggtcgtcatcgtcgtcaaaatcatcatcgccgtcagcaaatgggttggcgatgttgctatcatcttcatcgtcatattcgtgtagtgttgccgacgacgcctctgtggcttggttgtttttctgatgcattgctaacctcgcagccaactgtaacctagcccgcgaagggggaatgttcagtggtggtggtggaggaggcggcggagggatggatgggggtgccatggaaccatcggcgttgtttaaggaatctgtgtaggcacgaaactgcgaggggacattagtgtcccgatcaaaccttccacgggatagtattcctgacgtgattgcctttctgcacgtccaaaggactacccaaaatcaagatcagctactactcacctcggaattcacgtcttcttcgtccccttcaccgtcctcgtcctcgtcatcgtcctcatcgctgctgcttccgaaccctgacatcagcgggctggtaccgccaatggcgaacggccctatcccgtttccattattctcactcaattcaataccgccatttagaccagcttcggccaaagcattagatccggtagcagagccagagccgctaatgccggataagccaatgctgcccaacccgccaacagctcccaggctacccctgtgacctaaggctacctcaggccgaactcccccgagaatagcattatctcgctctcgagtttcggccagggcaccctcaacgtagttgatccaatcctgactcatgaccctgtcaagaaccatctcagacaacagctccggcgggtgtcgctcggtgaatttaacaacctcctcggcaatgagagtgaggtggcccatgtatcccatacgggtctttgtcttggcatgcgactcgtcgctaactctttgaccattgataatggctgatgtgatattagctgcttcgaagagagacacagccaatgtggggttgtggctacgatccatgggaccgttaaacacttgctggacaatatcgtagacgacattgtgaaggaagttgttccatggataggcgaaaaagaaagacttgattgagcagaaggttagttttcgaggaacggaataaacaaggatgtcatccttaccagaatggtgggcacaactcgatgctccacgaactgccgtttaaggtagtctccgacaacgggttcggttgccttcttcggctgctcattcgactgagcagtagattccaggccgggtgaattgatttcagtgacatgcacttcaggggtgttgaaagactcggatggctgatgagctgcggtgctgtctgactgttccttgttgcttgactcgactaccgtcgaggaggaaaacagaggcgcaggcgtatcttcaggatgagggaagaaggtgcggtccagcgtttctgcttgagtttctggctcctttttctcggtctcagatgcgccggtccggctcaagattggcaacgtaacatcggcctccgaatcttgcgacttcgtttctttaccctgcgatacgcttgggacatcggaggattcctcatccttggactcacttccctccttctgttccgttgaagtagccgggacatcaacggtggacgtagctgctggaactggttctgcaggcttgggcttggacggagacaagggggcaaccacgagatctggtatttcgaactgttgctccgtgaccttttctgctgccacgttcaatctcggagaactcaatggctcatccacaaagtcatcctcatccttatctaggtccgaggctggctggggcagggtgatgtctgcctctgccttgacaaattcatgagaggtgtcttcgctcatctccttgctgggctcgacttcttcaaaaccatcatcgtccgcatttgtaacctccaggcggcggggttcctcttgagcaggatgagacatgcgcatcgttaggtcatctgccgaaaagttttcatcctttggctggacaagtttcccgtctgttcgtagcctttggcgttctgtatctctcaccgcaatcaattcctccgctccgacttcattcaggagacccatgttgctacagtgcaggagctcagccataagctcgcaagttttgaaacgatcaaagccaaggggttcgagcttctcgccaaatgtggaatccaagtgcttcttttgcgacggtgcgtccatgatcaggctcatgaatttcggcacgttctccgcgaatatgcgcagcagtgttcccaagtaaatgggatcatggcttgatggcaccacattggcttctgtcccgacgtcggggtcataatccgagttattcttacggattacttcaatgacaatgccgacaccaactgtcaaggggttaccaccacccagcatgtagcccaccagttgttcgacgcaaggtttcgatacaagctgccgagtaagctcgtttgggccgatgcactgctgttcgttctgagaagcgttggcagaaatcgtaatgatggccttgataaagtcaccggcggctgtctgtactacccagctattttcagggcccaggcatgaaagcagcgtcgggataatgtttttcgagtataaccactgattgaaaagaaggaaaatacattagtaaatcgaaagacacaaggtggggttccccagttgaagacaggttaaatgtttggttacctcgacaattccttgcccgccctcactgcgatccaaggcaatgatttttagaagaaggtccatgatcattggacattcgacatgccgcaagagattttctacggcatttggcaggttgcgtagaaggtccatcatatcgtccgtcttcttctcaaatagtgactcattaattttggtaaagtagctggcctgcagagggtcgaggggagaggggcgagagaggaaggaccagaactcgcggaccatgtgtcgattttccgtaagggcctcgtaaatggaccaagtatctgaactcaagacctcgcaggcaacaaatgcatatctattgcgcctcttttcctgctcatcgtcatcagcctcggtggtgtcggtggcacgcgacgaggcgcggggtcgtgagaacgggagcaagcgccctttgcccttggtcccggactcatcctcggtttcttcatcgggggtctcgatgacctctagtcgtggtgcgacggcatattcaagaagcctttcgagggtcttgtcttctcgtagatattcgatgagtttcgtgttgtgctgcttgagctcctggatcaagtcgctctcatcgagaagttcctcgagcgtaaagtcgggcttgtcgaggatggtgtcgatggtcgagatgttggcgtaaccgccaaatctccaaaacattgtggcgggctctacgtcacggcgccgggcgaggagctgcaccagcaccggatggcgagacgaatggaaataagctcagaggtccggctcatgcagatgcaccgcaatccgggtggcaggctcgtggggagggtccggagtcgctgtcgatggaaggaatcgcccagggttataggagagagtggtaaagttggtcgtgcgactgccagccagtaggactagcagaaatggtggtcaggggcgcctgaaggaaggacagcgaggagacgctacagggaacgatggcaggagccgaaggcagaagcgcacggtgaatgaagccgcaggctcaggactggtgcagtgatgatgcactgcaaggtgctcggctccggaatttctcaacaagctcgatgctcaacgtgcggtttcgcttggcgcggtgtcgcagagctgaagcaaccacacacacatgggggagcggtggtggtggaagcaagttgaagtgggatttgtcactcgggcgcgggcggcagaccgaagtgacctgctcgctagcgatatttcctagtccaaacagtggggggacggcctggtctaaggtatctgatatggacgagcgctatcgtggtacctgctagccccaaaggcagtttacgctccgccggcaccaggcgctggagatctgccttgtcctccaccattcaaccctactactgacgcctctgcagggccgagctcaatgtcaagattacgttttgtactaatgcccctggacagtttgtttactcccctcatccgactcttcgcacgcactctcgatggattggaccagccgaaggggtttccccgtcagcagccctaccgccgaatagtcggtgcaattttgcaggttgggcatccagggcctgggaagcgcagcccagcatccactgactgctccatccagggcttgctatccgatccgccaggggtggagaattcaattcttttgttacataattacgggaccacatcttggcatctatcgtagacgacagccttccatctcctcactcttgggccctgtgcaagctgcaggcgagctgcaggcaagcgaacaccaatcgataaatgagagacaagaactgtgcctgcctgccatgtacccatccataagcatccacttcactgtaggacacgattctgagcgagtcacaatagagcagagaaaccaaacaggcatatgaggttgcttgactaagaccgtctcgatttatcctctctccccttactttgacatatctcttcccgtatcttgtttccaagacaactgccccgagtctgagtcgtagtttgcttaatctcaaacaggctgatcgtgattcagatatagtactggggttccgcatcgtggacaaggtcgaacaaggaactgggagctagaagagagacaacgttccttgcaaaatatagggaactagatgggatagcttgactcgagctacgtagttatttttcacaggctcatgttaaaagagcgagacgtgcagacacaagaatcaagattgataaatataggaaccatctattgatcagaaccggcagtcggagacactatcaagtagatgtactgccagcaacttgatacacttgtcctcacacttgtcctcgccaccacgccgacacccgtcctctcaccactttgtacgtccagcgaccctcaccggtcctgcgcacacacaccctctcaccagctttatcctacatgtacttgtctacgcagcgccgttgtaggccagaagatttgggctccccggtcccgcatcggcgacgacaccccgtgtggccaaatcaagaattctttgcgtcacagcagcgggcgaggtcaagccttccttgcgcatgaggtacaaggccaaacccgagacgtgtggacaagccatgctggtcccgctgtaccttgccgttgcttgaacgttcccaatgaaggtgctgagaatatcgacaccaggtgcgaaaatatccagggaacggccaacgttggagaaggaagcccgtcggttcctgatatcgatcgcgccaacagtgagggcagtgggctcagatgctggtgaaaaattctgggcatcccgattttcgtttccagcagcaaccacagtgaggattccgtaacggttgtacgcatttctcagggcggtatttagggctagggagtagccacctcccagggacatggagataacagacctggcagctcgaccaggcgtgctggtgatattcctaactgcccactcaaatccgtcgatgacgatgtcggtagaagactggcgacgaatcatgtaagcgaccatctggttgagtggtttgggcgacggggcaagagattgagacttacacttccgctcgcaaacacctttactgcgataatgttcgctttcttagcaactccatgcaccctaccggcaatggtaccagcgcagtgagttccatgacccagctggtcaacaaattgagtgccgggataggcgttgtaacctagatgtgcacggccctcaaagtccgtatgttgaatgtaaaccccagagtcgacgacataggcccaagtggtagcgccggcagagtcgtcgtagacatactcgctccagttgggagtacggtgagatatggagcccagaccccaaggagcgttcgtctgtctgatattggctcggacgtcaatggcgccagatgtttcaacaacctgtaccggttcaacagcaatgacctgcctcgaataagccaacatgcgcatgaaatgggaggaatgttgattcattatactaacatcgtcgctctcttcgatttccttcacagtctcttggtcaaactcgccagagtagcctttgaagttgtcgttccagactttgtcaacgccgatctcctcacgcctggtaaggcttcgctcatggacgctcctgacccatgagatatgtgatgaaacatcggaggcattggcattgttcttgaggacaacaatgaacttccctgaaatatcgggtccgtcctctcgaacagttggggcagcgagggccaccgaagcggcaacgaagagaaggtggatggcaaccatgatggtgattttaatcagcgggcttgttgatattagctggtggtggattggcttggagaggagttgaatttttccaggtgaatgagaatggacctcctttatactctttcatattgttcatcttcatatatctttatttgaagtacatccattggtgcctgtgttccctccaagtaaattggccaggagtcaggcttcgtggcgatagtacagttcgtacgactgacgctgtcttgaaaaggcctttattggaatctcatacatttggatcttgtatatattgagcacagattgagtctagctggtgatggttcaagtcgacggcattgccggcatcttgtgcctcgaacgttgggcgtacttctcgaaccaatgtcgaaactttcatcccatctcgagaggctgatgtaaccgggagaacgttaaacaacaactttggtagccctgtggcgttcatgagagattagaaacggtcacggatgatgggatgtgtcttagatactcaaaattctattgacttctgcaggttgttcttcgcctccggctgcctcacatgtgaccgctagtctacactgtgttcatgattctaaggcccttatccagctcgtgcctcacaccatctgttgcagcatagtctttgagcacaatacctctccaccaaccgtaccattcggctatctctccaaggtctgcttcttccagcgccatccactcctgaagcttcgcgttccacatggggaacatatcctgaaccagaacctcggtgatcattgcagttcccagcaacgcacgccacttgaggatacctgtgagtacaggtaggtatgcttcttgatcagctggatcgacccggaagttccgtctcatgtatttgcccatggatggtaggatgtgggacatgatgagaggacgccactgttcctccaggatgttctcccactgaggaagaccaggaacgactcctcgctcaaactcccagacatcaacgagctgcctgaactttcgcctaacatctgcaaccagcccagttcctcttgggtcgagatggtagggcggcagatattgtaaccacggaaagagccaagtatgtggcagctgatgactttgccgcctctttctggggttccagtctgaaacagcatcttctagcttgcgtacgatgctgttcattaactgtgctcgcacaaagggagggagaagttcgtcccaattttccagtatacggagcattggcgtggggtcttgaggatcccacgttcgaactgcggccaggacctgtggtaaccagatcttgtacattaaactctcgtaaggggtagtggccttgtgatgtgttcggtaaacgccgttttgatgatcggcggatgagtcccatttgccaactgctttagcattgccggctgacttgagtagtaaactcgagagatctttcatttctgaagcatatttcccaggctcagcgaggggatcccagccggcctcctgcagatatggctgaagggcggcaacggcgatatcagcaacctctgcattagcggagccaagctgcgcagcctttctcaggcagctgatggtttggtcccattcagtggctgaaacaagctcctgggacaccaaggtagaaaacacttgcaatctttccaggtcggaccgaacatcctccaactcttgatccctctccttgagttccagctcaacccaagacttcttttcttcaaggctcctccattcctctgagaaagccaataggtccgcctgagctcgcttaacgagcttccttgcttcgacaatctcgctggactcagacactccggatgtcggtgtcataatcccgctcgtagacgtaagcatcttgcccccaggcccggtcatatctagaataggggtaaaggcttctggtatgtgtaggccaggagcagatgtttttaattcttctgcggtcaggtatttcgtcttttggcgtcgcggcgtgcttccggcgctatcgaaggcacctgcgatcgtcttcttcatctttcttgcccttttcttcttcttttcctcttcatcagagtccatgatggtctctccacgcattttcgcctgcctcttttcctcttctcgttcttgggccgttttctcctttactgcaccaagaccgacgccttgaggacgtagatttgcctcaacaatgacatttcttccctgaccctctttgcccaaaccttggccttccacatatcccatcttggccatcattcgtgcaccaaaggacttggcatttattttgcccttggtactaaaggcactgggctgtggcttgttgcgaggtggcgatgcatgcttgatagcggcctcacttaggacaggttcgttcgccgaggaaggcacaaagccttttcccaagatatttctcccatcgaatttggttttgagcgagctgttcctagacttgctggtcgcctggctgccttcattaagctgggcctcagcttcttcgctcgctttgcgaaacccgaatcctaggccggtgccaagaaggtcgttgtcctcttcatcctcgtcgtcgctttgtgcagggccattgccaagaactggcctcttatcttcgtcctcctcgttttcatcctcgctatccttccttgtagcagtcgagacaaagctcatgcctttgttacgcagattcttcctcttccattgcctcccactgccttcatcctcgctgtccgagccgaagatgcctagagctgccttctctttgtgattgccgcctagccgccgacgtttgcggggattaaagtcgccaaagtcatcgccatcctccccgggaatgtgtcgctcgtcttccgagtccgaatctgaagaagaatagtcggcggcagaagccttggcgaagcctgggtggctaaatgtagctccgtccatagctgcgtttaccacgtgtagaatcgcatttcctatgtcgcaagcttcgttatgcggtcgccaagcagagaagcagaaaaagaaagcctccttaatcccgagagtaggaattagaggcgataaaaaacacctgggaatgacctaggcaacgatcacaccaatgcgccaggtcgtccagggactgttgatgcgcttctctggaaattcttatcgccacgtgatgctatcgcttctggatattttagacaggggaataataatggagcacgatgatcaggcagtcgttggggattaggctgttggcgtataacagggcgcgaaggaccgcaggtggctcaggtgcttatagaggcaaggaggtactgattttcccttggcctctctgtcaagttcaatggttcccatttagaggaccagtcactctttgtagaagtaggagccctggttttcttgtggagacgatgaatctaccctggtgcaacattcggattattccagctgaacgtaattaaatggtagcatctggagctatggaaaatggaactctgcgcaaacgcatgaggtctagcaaaatgtttcttgactttatttggttgatggaaatttagtaacggttcattttgtaatgctctctcactctcagacctataccatgtgattttgatggtcattcatagctactactgagagcgtgactacttgatggatgggccactgtcttgggctcccaaaaagcagattgagcagggaatattccaggctcactactccagcgcataattacgccgtcggctgacttgttgttgaggatgcgttggacagcatcttatatggaagcgacaggacgcatgacatcatttgtgtttctgcggcaatggatggctcaaatgcatctggcttcaaagcagcctcgtgcagctgccaaatcgcagcaaccgggctgacgcgcataatatcatacttcatgcgccgggacagtacagcaaatcagttgtcgcagggaattgccttagtacccaatgccaaagcagcataaaggatcgaatgccaccggcttgtgcctccagacggcggccctgggccggatccatggccgatgttttggagggcagggacctgggcgcacgtacctagtggggtgttaggcactgtttgtagcgctcccgtctcccaagagtgttttttctggtggacaaatcaggtgacgcgcccttgcccctgtcgctggggtttgttgacttttagcatcatcctgggctacccccctctctgcataggcggtgggttatattatcggcgacgcaccgcatctggggttcttttggcgttagagatcaacagctccttcatgccacctaatgttcttggtgttacgcgcgcaatagaaggtgagcgtcgcaagaccattctccttcacactctttgtgtgacaggactggcttagtccattgcgctttgaagcactttgcagctagtgccgcccttcctgcctaaagcatttgctaactcaaagacagaatccgactacttccttccactcgacatctaacaatctgcctttatgcggaggtgcagaccggccatcctgatacccgagttcttgtcctgcttgcctgtacttattgagctgtcgaccgcccttgttgctacatcttggtatataattttcctcattccatatgaatttcaaaatgggcacccaaaaacatttactgcatgttcgccagctaatcaacaaagtagttcatcatatcgcccaccctcgacgacgtaaaagaccaccagacctccgttactcttcaccagagcgctactttttcccacagtccggaaagaacttcggcacccgcgaccaaaatatgggtgaccaagaggtggatcttagcactattccgttgctagaccgcttcgaatccaaggtgatttcgcattcctcactggcggtagctggcaatttactcacgtggatcttcttgtagaattggaaatatcgaaagtcaggatacgaagacgccgcgaaacagttctcagcatcgcccaacgaatccgacccatgttttcgcccgttcttgagcaaccctgggctttggaaagccgccgtcctcgactccaacgtcgccgcacagctagaaggtgtaaccgccttgtgctcattcctcaaatatggtgggagtgaatgcgcgctgcgaacaagggggcaggccgtcacaccgatagtcgaaaaatgcttgtcttcctcgaaagccgccacgaaacaaaatgcgatcgaggctttgctactattcatcgagctggatgtcgccgacccagtcatcgaggagatgcttcccggcctgaacaataaggttccgaaaaatgtggctgcgacactgaatgctctcacacaaatatatcacaactatggatgcaaagtagtggaccctaagcctgttctcaagtgcctgcctaaggcttttggtgccgcagacaaaaatgtacgcgccgaggcatctaatttaacaatcgagttgtaccgctggttaagggaggccatcaagcctgtgttctggtcaaatttgaagccaacacagcaaacagacttggaagctcagtttgagaagattaagaacgacccgccgccaaaacaagaaagattacttcgttcgcagcaggcggctgtggatgccggcgctggagaagaagaggaggatggcgcagaggctggcgaggatgttgttgaggtggacgccttcgacttggcagagcctcaagatatcacaaagaatattccctcgaattttcacgaaggcttggcatcctcgaaatggaaagagcgaaaggaggccgtcgaaggtctctacaaagctctaagtgtacctcgtatcaaggacagcgatttctcagagattaatcgcggtctcgcgaaatgcatgaaggatgctaacgtggcggtggtgacgcagtctgcgcagtgcattgaggcgttggctaaaggtcttcggcagggctatgggaagtaccgatcaattgtgatgcagcccatcatggaccgactgaaggagaaaaaagtgactgtttccgatgcgcttggtgccgccctcgacgctgtcttcacatcaacgaatatgacggattgtctcgaggatatcacggcatatttgggcaataaaaacccacaggtgaaggaaggtacaatgaagtttctcattcgatgcttgcggacaacaagagatgtacccagcaaacccgaaatcacttccatctgtgaatccggcaagaagcttttgtcagaatcaagcccggctctcagagatggcggagcggaaatattgggaactgtgatgaaaatcattggggaaagagcaatgaatccccatatcgacggactcgacgacattcgaaagaccaaggtaaaggagttcttcgagactgcggaggtgaaggccaaagagaagccaaagccagttcccaagccagctcctgcggccgccccaaagaaaatactcggtggcaaaaagcccgttgcaaagaaggctgcaccggccgcggaggtggcacctcaagcagcacccaagtctctgggacctgcgagcaaattaggaggaccaaagtctgggcttgcagggctcaaggcacctcagaagcggacgcttgccccccccgggtcagcatcccctcgacgcccaccaacaggccctcctgctatgccagacgaggatgatgtgcctcccccgcagccacgagctggcttgcgaggtttggcaggacggtcacttgctaagccggcggcatcaatgcctcagatgcctcctgactcacccccacctgccagtggcttcacagctgtagagcgtgctgaattggaggagttgcgggctgccaatgagcgattgacccggcaagtagacgacatgagacaggagaggaataagtttatgaccgagattcaagagcttaagaaccagaacgccggccttatcgaagaccatacgcgtgatgttctcagcatcaaggccaaggagacgcagcttgtgcgagctaggagtgatgccgaggccaccgagcaggccaatgatagattaaagcgtgagcttgatcgcttaaagagagatctcgcccgtgccgagggtcttggttcggcaagtccaggtatgaacttttcgtatgatcttgaccttgatagcgagaaactaacaggcaatggcaggtcttgggtccccgactcatgatgatgctggaatctaccgcgactcgggttctgcttccggtggtcggaacaggatgagttttaccagcacactttcggaggagaaagagaacggagagacggcttatccccgaagtaagatcagccctgaattcagatacgcagggagcacaacctcgtctggccggggttctccagctagaagcttcagagctcccgcgtcataccgtgataatgacagcgacgctggtggcgtgggcattggcattactagggaacgtccaacatcctcgcttccaacaccatcaggagctaatggggctgagagttggaagcgagcggcggaggtgacaagccagctcaaggctagaatcgagctaatgaaggtgagttggtatcttcctatatgtccttcccatcgaccacatactgatccttgtcacaggccaaacaaggcttcgctcgaccttagatgttaacttgtggagacaaagagtaatgggagagacccagacatttgtgataatatgtatttgaggacacatgagggtttcacaggggttcaaggaattctctaattggcgactgttgaagcagtgcttttttttctttgggatgcacttcttttgggatcttaatgtgcatttgcatggcgtttgccgcataccccttttgttaacgcgcttgtggttcgcgaacttcatacatagaccttcgttttggttgatttgcattaaggagacatgcagacaagcaatgaaaatgcataatatagcagggtgaattttactttgatacatttactacatctgatgatattgcttaaagcgaatccggtcgctgagctggggtttaactcacaaagctaactagtaaaggtaaataggctggcttgactctttcatctttcattaggagttcactcccctcgctcccttgtcactttgattgaccttcaatcctacttactaccattatcaccatccttccccttttcatcatcatttcccttttggtcatccttttcactttgaccatcctctcccttttgaccatcctctcccttttgaccatcatctcccttttgcgttttatccgcctcagacttgggattgtcgctgtcaggcttttcctccccctgagcctgcttccccttgccaccgttcttgtcctttatcatctcctcttgctggttcttcttcgcctctttctctttctgcttctctttctcctccttctccttcttaattcgcttcttctcctctgcctcaacctttgcccagtcggtggtagtgtcggccactccggggctttctatgctctcactgagatatctcccgctcagtcgctgcgaagtctcgatacgggagcgaccaacaagagaaatgaaaagagcaaatcccaccatggcagtgagaaggaaccggtagtggccataccacgggggagcccagccccggatagtcgcccgggaatcggcgaagtagagagcgacgaacgcaccgaactgggtgatgaggccgtattcgagtggcatcaggagagttggccaggcaatgatgggtgcgacgacgcccatcccgtagcggaagcgggttcgctgaggatggggctccttttcggcatattccaggccctgacgatatcacgcctctggtcagcgacaaaggcttgttatgctagagaggtgcaagaagctatagcttacccaatggacggctcccaggaaggatatgatgactgcgccgtaccctagctggagaggctcgatgatgctgaggagatatttcgcagtgtcatggttgattaagatagcgttgtagaatggggtggctgcggggatgtcctttgtcaaatcccaactcaggaagacggacgcggcagaggtcgcaaagtaaggcactgtccccataagcccgaggatatgagattcacggggcgtgcggctgagccgcaaagcgtccttgactacgttctttggaagctgtgttagaatgtaatcctagtgttggaagtgattggggccgtacaatgtcatgtgcgaggccgccgccatcgactcctgcagttgggtgagcgcccgggagggtcagatcatcgaatgttttggtttctgctgctatcttcgaagggtcggatttgagcttctcttcgccgcgtttactttcggcttctaagggtgcgactgaatgaaaggagcggggggtactgaagccgctgacatggctaacccgttgatgtaattgaggtctctgggctgctggatgggtggagagtaaggctaaactagaggttcggtgttgaagagctacagtagctctggagcgtacgaagtagcttgggatgcggaacatggtgttgagactccaagatgatgatgtgagatagtccacacgatagagatggcatcaataaaactagtattacgtatggaggcaccggttacacactattgtgtgagatcgagatatactctcgtcttaggtgcatggatcggattggatcttgttgtgatcaagtatgtagtggatggaagtctcaaggtgttttggctatgggtttgtagatgttgattgtgatctagtgtcaagaaaacaagatattcggcatcaaaggcactgcatggagacgtaatggcatccttagcatcataatgaacgaatcggttttctaacggtctcatcgatgcttcaggagctccgatcaggtgtgacgtcatgacatccaggttctgtggatggagctcaggggagctagacggataagaataatccaggtggattgactttggcatgttggaaaagaagaatatgctgctgttaggccttttagggatgataatgctggaatagcgatgctcaattgccatgtcatgtatcgccactcttatgcgtgcttgatgaagctggaactagcagtgtctttccagctggttggttctcagcccaagtacaggtctagcacccagcgtcatcgtgaatggatgcgactatttcagtttagcgcgcttgctgctcttgcattttcaggttcctttccatagcggaactcgatgataaagcgtgagctgcgtggacgtagacccaatggacggattagtgacttttattcaaaattattcaaaataattcaagccattttgaactccaggaaattcccgagatttaggctgcacgaaaagagcctgacagaaaaatgccagtcagaacctgactctgtattaggctcaacagcaccgttatttacggcagatcgttgctctaaagcggcgccgccttgtctgagcgggaggaactttagaggttgtacctggcccacagcattctgcatgcgccttccaagtccagcccaaggacgatcgactgcaacagttgctccccgattgggtatggccagggcagcagcagactcgcccacagtgtcacagcccctccaccaggcccatcgcaagcactaaccctctatgagcaccactaccgggacagagtacccgcgtcatacgtccattctctcggggggttttcagagcctctgcaagcggtgacgtgcctagcaactgccccaagctgtgcaaacctgacctttgggtagtaccagtaatccctctttcctttcactgtccgccttctagtctcgaccgacgacgacacgatacagtcgcgagcaattccataccgacggccttcagcagctgcatctccccctcagctgattgttggactagtcattcctttgggcacccacgacgagcgcacccaccacgcaactgggctgcctttaaattccggccgatatacaacaccggcctaacaagtccgaccaccatcgagtacgccgacatacagaacagtctcttcttccttgccgaacgactgcaactcgggtggcgaggagcatatacatacgttgccattatcagaagcttgtggcacgatttccgatgtcgtcttagttcacacatccgatatccataaccctcatatcccaggcccgggtcacggcaccccgctctaatcatgttggaggggcttgtcgccgggttgctgaaccgcttcctgggcatgtacgttaagaacttcgaccctgcccagcttaaagtcggtatttggtctggcgatgtcaaattgcaccacctacagctgcggcgcgaggctctcgaccagctcaaactacccgtcaacgttatcgagggccacgtcggtgaccttacccttgccattccctggtcaaacctggctggtgcgcccgtcaaggtcttcattgaggatgtgttcctccttgcaagcccaaaggaggaagctgaatacgacgaggaagaggaggaccgtcgtaagcagcgcctcaagatggacaaacttgacaacgcggagctgctgaaggagcgaaatcaagagggcatgagcgctgaggagcagaagaagaaccaaagcttcacacagagccttgtcaccaaaattgttgacaatcttcaagtgactgtcaagaaccttcacatccggtacgaagactcgatatccgcccccggacacccctttgcccttggtgttactttggaggaattcagcgccgtgagcaccgatggacaatggaagcctacttttatccagaatgcaggagacgttacgcataagctggcgaccctgggagccttggctgtttactggaacacggactctgagcttctcggtacggggaggcagacagagccatccccagaagaggcgatgccgcatggcgaaatgatcgaaaaattcaaagcaatgattaataacacagatcaggcaggcttgaaccaccagtttattctcaagccagtaagtggacaagcaaagattgagcttgataaaactggcaatgtgaatgtgccccacttcaaagcaaatctcctattcgaagagattggcctcgtgttggatgatcaccaataccgtgacagtttgatgatggtggatttattccactacttcatccgccaccaggaatacaaaaagcttcaacccaagggcgtcacacccttggaagatcccagggcctggttcaaatttgcgggcaatgcagtattaagtaaaattcacgatcgaaatcgacgatggtcgtgggaatatttcaaagaacgacgtgatgaccgtcggcgatatattgagttgttcaagaagaagaaacaacttcagcagctcacggccactgaaaacgacgacctcagtaagctggagtggaaactcggttatgaggatctgcggttctggagatctcttgcacgaaaccagctcaagaaggagaatgccgaggctttgaagaaccagccaccccagcaagcacagcagggctgggcgtcgtggctctgggggactaaaccccaggaaaccatccaggagaatgaggagaacacccagatgacagaggagcagcgtaaagagctttacgatgccatcgaatgggatgagaaaaccgcactggcagaagctgttgatgttcctcgagaagccgtcaagctttgcattgaaacatctctgagtactggtagcttcactctaaagaagggaccgcacgacgatccaaaagaccttttaagtttacattttgacgtcttcaaagcaaaggcccttcagcggaaggactcaattctgggcaatctttcactaggaggtttacgggtagtagatggcactacgcccgatagcttgtatcccgagattgtacgcgttaaggacgcaccggatgccaagaagcgcaaacggctatctctgaacgaactggcggttgtggatgaagagccattcttccaaatcgaggtggagaagaaccccatcgagcgtgagggggatatcgccgtgctcggtaaattgaagcccctcgagattgtgtggaacccgaacttcgttgttggaatcgtcgacttctttaggccacctgagaggcatatggagtctatcactgcattgatggaaaccgccggtgccaccgttgagggtctacgtgagcaaactcgagctggtctcgaatttgctctagaggagcacaggaccatcaacgcagagctggatcttcaagcgccgctcatcattctccccgtcagcatcaccacatcggagtcgacttgcctgatagttgatgccggtcatattcatgtcaacagcgaattggttgaccaaggcacccttaaggagattcagtcaaaacaacgccagtcatacaacgacgaagacttcaaaaagctcgagtcagccatgtacgacaagtttatcgtcaagctcacatctacgcaggttctcatcggaccatccatcgacgaaaccaaggcacagctggtggaaaaggatgacgaagcgcttctccatgtggtagagaggatcaatgtagagttcgttgtggagacctcgattatgcccaaagcgcccaacttgaccaaattcaaggtctctggccaccttcctatgctgcacgccactatgtccgattcgaaatataagaatctgatgagaattattgacgtgtctattccaaaattcgcgaaccaggaggatccagagcctcctcaaagcggcaagaagaagactcgtcccaggcttgctacagatgcttctacgaggtcgggaaagaagtccgggcgagataggagccagtccgatgcgttccccttcatgcagccacatactgctgttgtgttggatgatatcgacgacgacgatgaagagtttgaggatgctgaagatggatctaataacgagcacctcaagatccagcagcgtagctttgaatttaaattcaaggttgacaccctcaagggctcactctaccggagcgatccgaaccgacagaagccagacgtcctccttgttgaactggtcgctgagcgtttcgatcttgaattttactcacgaatttacgatattgctgcggaggtgtctcttggatcagtcacggtcgatgactttgtggacaatccggccggggaattcaaatctatcgtatcgtcaggtgatagcgatgatcttcaagctggaagaagccttgttcacgtaaagtttgtcaaggttaatcccaaatcaccagaattcatgccagtttacgaaggtgttgagaccaatatcaaggcaacggtgtcaacaatcaatctcatcgtgacgaggaaaacattgcttaccctcttggatttcatcctgatcacatttacctctggcaacaatccacagcctccagagacgcctgcaattgccgatagccctggaagcgaatcccctgaagagaaatcggttgaacttgcgcaagacccaaagcccaacacgggatcaattcgtgtccacgtcgagctaaagagtatcagactcatcttgaataatgacggtatccgtctggcaacattatctctcaatcatgcagatgctggcgtcttcttgcgtggtaatacgatgcgagttaatgcccgacttggtgatctatcactggttgatgatatcaacatgggggcatctgagagttctaaccttcgaaagttggtagagatccaaggtgacgacctggctgatttcagatatgaaacattcgacgcaaacaacaaaaaggcatacccgggatatgacagctccatctacctccgagcagggtccgttaaagttaacttcgtggaggagccattccgcaaaatcattaattttgtggtgaaattcggcaaaatgcaggcgctctacaatgctgcgcgccaggcggcaatgaaccaagccaaccaaatacaccaaagcagtcgtttcaaatttgatgttatcgtcaagactcccattgttgtatttccccgcgtggtcgtacctggtcgaacgaaacgagatctcgtcacagcatatcttggtgaaatatacgcccagaataagttcgctccgatagacgatagcaaggactccgacattgcgatgaaaatatcggctggtattcgaaacatcaggctgacttctgacttcaactactccgacgacaagtcagaagagttggagatgattgatcatgttgaccttggtttcaacatcacacatgctgaacacacgcctggtgctcaacgtcctgataccgaaatcgaaggatcaatgtctgacttcaatctacgaattacccaatatcagttgagatctctgatggctatctcgcaatctgttccggctgcatttgctggagagggcgagggtggggacgaagaggccgccaaagctgtagatcaggataccctgcgccgagcgcaatcgatcaatcaaaaccaacaagccgatgatgggccgctcatccacttgggtccggaactcagctcggtcgacacgacatggacaaagctggatcttgtgttccaagtgaatactattggccttgagctcatccttgcagaggatgatcatccagttggtgatttggcaaaatcaagcctgtctcggttctcactcgacgagtcaaaggtcaaagtccgcatgttatcagacaactcgctggaagctgaactcctgatccatgctttcaccatatatgatagtcgaccgagcgagactaataggttccgtcgtataatggcatcagccaacaaagatgtccaccaactgatggcctctgttacaatgtcagggggcaaggaaagaaatgtgatcgcaatggcaacacttgacagtcctcgcgtaatcttcgcacttgactatctcttcgtaatccaaaagttcttaactgaggggctggttcaagaagagatctccccggttgatgatgaaagtatcctgggatcacctgatgagtccgataccgactcacttgcagttacatttgacgctcagcgatcccaacaggcaagatctctctcctcagctcggcaaagcgaggatactccgccccagaaggagcccgagaaacccgaatcgaatttgaatctggcattccgagtaaacttggttgatgctcaggtaatcctcattgccaatcccctagtatcaaattccgaggccattgttttgggtattcggcaaatgcttctttcgaaacagcattctctcacctttcaaatttcgcaagtcggaatgtttctctgtcggatggatcgcttcgagacatctcgtctgcgcatcattgacgacttctccgtccagctcagcatggacagctcccaacagatcactacagccattcatatcgagattgagccacttattttacgtctgtctttgcgtgatattttgctggctctccagatcattacaagggctggtgagctatctggaaatgacaccaagactcccaaggagacaccagcggaacagaaggctaaacagctgcgcaatgctggtatgaagcaaaaatctggcagtacatggggtcattcttcaactggaaagacaaagggttcgaaattagttggcggtgggggtcagagaccacacagcgaagtatcaaaattacccgttcgaacccaggaggagctttctgcaaccattgaaggcgtccgagttgttcttattggcgatttgcacgagttgccaattctcgacatcggggtgaagcagttcacggcctcagcacaaaattggtcatcgaatctcaaagcggaggtggctgtcgatatgtactcgaacgtctacaacttttccaaatctagttgggagccactcatcgagccgtggcaggtcggccttggtgttgctagagagattggaaccggcatgctctctgttgatttagcgtctaagcgggcattcgatgtgacaatcactacggctacaattgctcttgcttcaaaatcatttgatttcttgacaacagagcagaacgtgttggacaagccacgtgtgaatgaagctccttatcgaatcaggaactacactgggtttgatgtcgtggtcaactcgaagagcccgactagcgaagagccgatttcggtctcgttagaagacggcaaggaggctccgtggagttttgagcactgggaaaagatgcgtgagaatcttcttaccgaatccaaccagaatgatgtcagcatcactctagagggcagtggatttgataccgttaagaacgtacgaatcaatcgcgagggcgagttcacctatggcctacgaccgaaggcagatgttctccaccggctttgtgtagaggtcggcttaggtgctgacaacgtcaaatatgtgactcttcgctcacccctgcttttcgagaacgcgaccgagattcccgttgagcttggaatctacgattctcaggacggccatttgctcaagattgagaaaatcgcccctggcgagtcaaggccggccccagtgggcgcagcgtatgaaaaggcagctttaattcgtcccgatggaggctttgggtatcgatggagcactgaacaactctggtggaaagacctgttgatgcgacctaccaggcaaatcgtgtgcaaaggggacactgcggacccgttctatttccaagtacatgcgagatttgacaaggctaatcccctgacgaagtaagttcactgaatggttgattggaatatgaggtttgttcttctaatatgctaaccgcttgggaaggtcatatccaaacatgaagattaagctgtcggcacccattacactcgaaaatttgctcccttatgacttcaaatacaggatatacgaccgaaatactaagaaggattggtctaatttcctccggaagggaggtgtaagccctgttcatgtcgtggagctttcccacctcctccttctcagcgttgacatgcaggatactgtcttcaagcccagcgattttgcaatcatcaattctggaaccaatgaggatttccgaaaagagaaccgcattattctcaaggacgatcaaggactcccgcttcatctcaacgtacagtatttcaggattcccaatagtggaggtgccttcaaggtcaccgtatacagcccatatgtcgtactgaacaagactggcttggaattgatggttcgagcgaagacattcttgcagcaagccaggcccgccgcaggacagttcccattggtggatacttccgatcaagatcgaccaaaagctcttccatacatgttttcatatggcaacgacgatcaccgcaaccgagctttgctaaaggtagcagattcagaatggagtaagcctcaaagtttcgatgctattggcagtacctcggaagttgtgcttaactcctcgtcaaaacaaaacaaggaggttcatctcggcattaccgtgaagtctggcgatgggaagtacaaacttaccaaagtagtgactcttgccccacgctttgtcatgcgaaacaagcttggtgaagaacttcttatccgggaacccagttcatcgggttacttaacactccaaggcggtgctctgcaacctcttcatttcatgcaaaaatccaccgtcaagcagctctgcctctgctatccaggtgttaacaaccaatggacctcgccgttcaacatcgctgatatcgggacaacccatgtcaagatcgccaaggctggccagcgtcagcgtttagtgagggtcgaaatcctcctggaggaatccacggtcttccttagcttcagtttcgagactaagaactggccatactctatgcgaaatgagagtgataccgaatttaccttctaccaggccaaccccaacgtcgatgaagacggcgttgaggacctcagtgggtggaaacctgtgcgctaccgattgcctcctcgaagcatcatgccttatgcttgggatttcccggcagcgaagttccgtgagatcatcatttctgttaacaagaaagaccggcacgtcaagttggctgaaatcggtaaccaagtcccaatgaagttcatttcgccggatggacatcaaaaaatcattgacatcaacgtggctgctgacggacccacccaaacattgatcctcagtaacttccgggcaagcaagagcatgtacaaacccaaggcagttgagcgaacaaagtctggtctggaggcattcgaagtcaaggaccaggacactggtgctactttccgtgcgcagctgaggctggctagtgtgggcatctccctcatcaacgcccagctcaaggagttggcatatctcaccttcaaggatatccagcttcggtacagtgactcccctctgattcaaactgtctcattgtcagtcaaatggatccagattgataaccagctgtatggcggtattttcccaatgatcgtctacccaagcgtggttcccaaaaaggcgcaagaagttgatgcacacccttcgctgcatgcgatgatcagccgggtcaaggatgattcctatggtgtattgtatatcaaatatgccaccatcctactacagcagttgactattgaccttgacgaggactttgtgtttgctcttctggaattctccgacgtccctggcgcgcgctggacgattgaggctgagggcaagctgtgtgatgagagtttggatattccccagcctacacagcaggcagcaggacaggacatctactttgaggtcctcaatattcaaccgatgcaggttgatttgagttttatgcggacagagagaatcaatgccgaagaccagcaatctacgcggaacccaatcatgttcttcctcaacgtcatgacaatggcgattggcaacgtcaacgatgctcctattcgcttcaacgctctcatccttgacaatgtgcgcgtttcgactcaagttctcatccagaacatctcaaaccactacagtcaggaagtcatgtatcagatacacaagattctgggttcagcggatttcctcggcaaccctgtgggcttattcaacaacatttcatctggtgtcacggacattttctacgagccataccagggtctcattctctcggatcgacctgaagagtttgggatcggtatcgccaagggggcagcttcatttgctaaaaagactgtctttggtttcagtgacagtttctccaagtttacgggtagcttgagcaaaggcctcgcggctgcatcactcgacaagcaattccaggatcgccgtcgtatcactcgagccaggaacagacccaaacatgcactttatggagtggccgccgggacaaacagcctactgaccagcgtcgcatctggcatcggtggattggcgcggaagcctctggagggcgccgagcaggagggagcccttggctttttcaagggagtcggcaagggagtgcttggacttgccacgaagcctgctgtcggtgttttggatatggcaagcaatgtcagtgagggtatccgcaatacgacgaccgtattcgatgggtccgagctagagcgcacgcggtacccacgtttcatcccgaacgacggcattgtgcgaccgtacaatgcccgtgaagcgttgggccaatattggctgaagcaggtcgacaacgggaagtactttgacgagcaatacattggtcacttggaactgccaaaggaggatatggtagtcatggttacctttgcacgcattcttctcatcagatctaagagactggctagtgaatgggatgtgccgctaaaggatgtacagacgattgccaaagagcgtactggcgtaagtctgacactacgcggaggtgccaatggtcctttcataccagtaggagggggaggggagagaggtttcctgtacaagatgctggggatcgcggttgaagagtacaacaggcgttttcgaagcggtggcgggtagagccaagcaggaagaagcatcaacatcttcggaatccggcgaggagcgaaaaatcggaaggaactgttagatttaagcgggagaaggggggggggagtgtaatgagtttatcggttcttttgtgtttcccagttttatccatgtccgtatcagataacggccccgataggacaacgtatatttatccatcttcccatttactttatcttataccctgtaatcagtatgaactacaaatctacgggttaatggtggtgtgtacgtaggcatcttagctgctacgactacttccctagctagtgggcttgacatggatggtgggagccacacgcgtccccaggatctctccgcattatcagacgcatggaaggtcgcacctgaaggcttgtttgcacatgtatctggcaacgaaggcggtgttcgatattgggagggtctgccgatccgatcacctttattgacgccaagctacggttccttgtacatagtgaatgcatgaattcgatgcggctgaagcagatcaacaaaagtgcgccagcgagccggccagaacagaactggcctctgcccgcgagcatggctttgctcttactaccagcggcgtaagccgccatatgaattcattccgctctcggtgccaagttcatcctcaaccacctacctaaacggatcgtcttgggtgcatgggttggagggagagactgtccagtggcgatgggcgagtttgtcaatgatcattgttcattcagtttctgggactgttgtccggcttggcgtaatagtgtgtgtctcggcaagcaagcttgttcgcatctgcgcgccactccggggcattctcctctcgtgcgggtctggctccggctggagacacaaacaccacgctgatttgatatcgaaacgtaagaccagctatcttatgtgggacaagtgggaagcaggtgccaagagatggggccaggccgacgagtctggggtggtgataagcggtcctatccatatgtggcaaattgtcgggtgatcaagaaagtaagatcgaggagagggattgggccatgggctgagaatctcaatcactcggctcatctgaaggatcgagggccagaggaggcccttgaaaggattggcttggagccatgcatgcaagtgctaggggatcagggtcatatgcccgctggtcgtgcctattggcctgagtatgtctttgtcttatcaacgaccccccgtttcttgcctctggagctctggagaggcggccgtcagatcagcgtccggtggtcttggcacaggctcttttgaacaagagctccggaccatcagtcgcatatcaattatcaatggagttatggggacctggaggctcgagctcgataggaacacgcctatcaagggactggaccagagatagttgaatctgtagaacaaaatggccactaaaagattctcaattaggcctggagataccaactgacaagatacgctgccattagtgccacgcccccagtcgtcgaaccaaactcgccggtgctgattggttcagtctctctgcaggttacattgtccttcccgaacgggaagtcagacactagagacgccgagcgcctcccgaaagtagctgctcatgagaaacaactaaaattctgcccaagccttggtagcggcatgccattggctggcagcaggcccatttctggggtttggctgctggggctttatcactgacgcgagcggcacggagcaccagcagacggcgaggaagagaaaaagaaagaataaggaagtgtgagtgggacatcatgcatcgaaggcttcgagacggccaacgaggcacgccatcccctccatcgccccgtagcaccactggcaagcgtcgtttcttctcaggccgatcgcactgtggtctcgtggctttccaaaccttcaatgcacagtgagaatgccttggacgacggttgaaaaacctcgacggccaaagtcgcagcggagcgccatgacacgagaggcgctgctattccgtttcggggctgcctggccgacgcacctataccagccttgaccagggtttccccatcacagggacttttttttcaaccccatcctgaccagggctccgcgaaagctgggacacacgacactatggatgtgggcgtcgaagaaaaaaaaaacgagggatctggggccatttccggaagagcaatttcacgtgaagaggaagataacggcgcagggccgagagaccctgagatgagactctcatcttagctgacactgggcatctcgataagaaacagagacgattgagggatgcacggagggacctggtgggtaacgggaaagagacaaggtagcgacggaaagagctccctgcccggctgtccagggcaattggccattgccttgacggaggggggaaggtgcatccaagccatttgctatcgtacctccttccacggtgctgacctaccgcaaaggtgaggaaggtcagctctggtatgctgtggccaagctctacgtttaaagttggaccgcggccctcgccacttgcctcctgctttatctcttgctcatgctggctcaacggcttcctctaccataattagccttgaacccttcctccgagatatcctcagcgccacaccactctcgtccagagagaacccactctgttcttaatttgcgtcttgtcgtggatcccaactgcaaagtgggtagacgtggtgttagtagacctgggcaacgatccggcgttgcatccttcggcacagccgatcccccaaaacgctcccaccccagaccaaagataagggcgggtgaaaaaagggccttatattcgccctgtctgtcgcgtctccgcaggatttttttctctcggttcacccagctctctgttcaaccatagaagccctggggcagcatagcgcaagcagccattgacttggtccccgcctcttgtcttagaatatacccttcggacaggccttgtcctacctcgccttcgcaatggccgataccaagacgacgccacacactgacccggctcttgatgctgagaaccagcatcatcatgcccacaagaaccacgcggctagtgcgcaagcaccagacgacattctctacacgactggcacaacggccgacgcccctcacgtgcctctccagcaccaccatgagcccacgcccatgaaggaggctgaaggggagaaggtcaccaaggtgccgtctaccactcccggcacacctcccgactatagcgaccatgaaaaggccggtgtagttcgtgaagctgcttcttcaggggaggaacccagccgcgcgaccaatggcaggttcgcggtcgtctaccgccatcgtaacaagctcatccaccttgtcctcctgcttctcttcactgggtggtggattgcttccgttgttgttcaccgacacgacaagaattgggttgtccctttcctgctctggctcgccatcactctccgcctcatcttcttctatgtgcccatccgctatgtgtctaacccgatcaaatgggtctggcacaacaccgctgtcaggatctacgaccttgtccctgagaagtggcgcagcttggctggcggtgccgtgacggttgccgtcatcctcgttggctccttcgtcaccgatgagagtgaagacaacacccgtgccaaccgcgccatcagcttggttggcatggccctcatcatcttcttcttttggcttaccagcactgcccgaaggtctgtcaactggcgaaccgtctccggtggtatgcttgctcagtatatcattggtctcttcgtcctgcgcactcaagttggttacgacattttcaggtttattgcggaccgcgccagcgacttgctcagctttgctagggatggtgttgctttcttgactactgaagagatctcccagtacctattcttcttcttcagtgtccttcctgccatcatcttcttcatctcactcgtccaggtcctctattacatcggattcctgcagtggttcatcaagaagatggctaccttcgtcttttggatgttgggtgtgtctggtgccgaggctgtggtcgctgctgccacacccttcatcggacagggtgaatcggccatgcttgtccgccccttcgttcctcacatgaccaaggctgagattcatcaaatcatgacctgcggtttcgcaaccatctctggttccgtcctcgtcggctatatcggcctgggtctgaacgccgaggttcttgtttcctcgtgtatcatgtccatccctgcttccctcgccatctccaagctgcgataccccgaagttgaggagaccctcaccgctggtcgcgttgtcatccccgatgaggacgagcacagagccgagaacgccctccacgctttcgccgatggtgctctgctgggtattaggattgccggaaccatcatggcttccatcctgtgtattattgccgctgtcggtctcatcaatggattgctcacctggtggggtggatacatcaacatcaacgatcctcagcttaccctgcagaccatgttgggctacatcttgtaccctgtcgcgttcctcctcggtgttcctcgaagggactttgacccaagtaacccggacctgaagagggatcgtgatattctgttggtctctaagctcattgctgagaagatcatcaccgtaagtccttttttccgttgtttcgtactctactcgatgaccatacctaacacaccctttcttagaacgagtatgttgccttctccaagttgacgaccacccctgagtactccgagctctctgcccgatccaacctgattgccacctacgcctgctgtggtttcggtaacattggctctctgggtatccagattggtattcttggccaactggcaccttctcgaggtggtgacgtttctcgccttgccttctctgccctggtttcaggtgtcatggccaccctcacttctgccgctgtcgctggacttgttcttacaagccagaggtagtggagggttagacgcaaccgtcaagtaaataatgtagcatcatataatatgataccccatatatggcataataggtacacggcccgccgtttatatagccgtctattttttgaatatcaatcaattcaggattcgatatatccgtacaccagcgttttcgatgtggagccgtcaagtgaggtgaacctgtattcgtcgtaacagccaacgtatgaagtgttggtgagagtggcggacgggagagcaaccggatgtgtgaaaatttgtcaaagagcggtttggtggactgttgtacgctcacggacggtcaccggatggtctcaggccggagacgccagctgaaccagctataacagcatcctggtcgacagtatgacgagggagcgagcagaaacggctttatatggatcgatgtatttcgaggccaacgaatattccccaagggcgtagaggattcatggtcctggccgtgactgataccccctttatccctttacgccagctgccttgggtaaacgagatagtagtgccctgttcattatggctatgatgctcatgatcgatcgttccttctttacgtttggcgagtcgtcggaggtgagtgagtcgttctcagttgaagtcatgactgggctgacaggagcaacaggggaacgagcaaagtatttattgcgccgcaagaggtcattccacttcgccatgaagtaatcacaccttttatgacctgggtgccgtgctcacaaatagaccaatccatctcagaaaactcggccttacccaagggcagtgggtctacgcgctgggggggggggcttggatccattcgaggcggaagcaggcgaggtccgatgggaattgaccatatttcaccattattaaacgaaaagacagaggacaggagaatggcattatgtaaaagattcaaggttttgtctttggaggacggccttgcccgtgaggaaccttgagctggtggcacggcgccccgatcgtgaaccaatcccgggcctgccgattgaggaaactcctccggccttgcgatttgtgtaatattccgggcgtccaacgagcgtgagggcagctgtggtttggggctatccatcagcgctacggtgatgctcagatctgaggaggacgggctgatgggaggattcaacatgtggttgagctctgacatccaatcatggtggttcggagctgaacgtgtgagatcgagggacttttttaagatggcccatgcatgaacgattggtggattcgcgatttaagcttggctttgggcagagccgctcggtaatggcaaagctgatgcttgattccactatgttgggttggacgctgtcttgccgttcccttcatgggtcacctcgcgatcttctaagcttcacgtcgaagtaggtcctatacaaggcttggggagcgtataatggtatcgcgtaggtaggtaaggcagctactaaggacagcatatggcacacagcctagtcgtcttccctcggaggatgcggcaacacccacaccatctcacggtatgaaaaatctccggtttgagtttctcctcgcaaccgcttccagatactaatctataaccttcaattcccctacgaaggccatctttctctaaacctggttggtactaataatgatctgctcatctatatgatttcaaatgtgtattgttttcatacgagcaatcgtaggaattggtttcgtatgtgctaccaactgctaatggcttcgcgctactgattcgtaagttaaaatcttgaacctaaagtttatacgaaatgtttataggaagggaaatttcgtggcgatagggttcgagatatcgagattagccacagcgctaagaaaaacatgaaatttggtcagcaagaaaaaaatctcgctgtttgttttggtaggcacaagatcttctctggcaaggcaacggcggcaccaaagcaaagcacttgctagggtcattgtttcaatggttgcagggcatgtaatctggttacacaacgaagagggatacagatattcattggtacacttgaggttcatatttttttgccgcgtatttgattgatgtagaatttgtcatgctttgggctgatgacaaaaaccgttggcacgctgacaagccttctgaattcaatcattgttggtgcatgcaatcaatcaatcaattagcgtgccgcagcgacagtggggccgtgcggcctttcggtacgtcggaagcccgcggcccctgctgaggcctgggcaaggcttgttcggagtccagtgtgttgccggctgtggcacgtagcattggtaccagcagagggatgatggtaataccgcaataagcagaggtggcggccagatgtccttgatcacatacctggccgcctctgcatcgtgggtgattgcgatgaggtcatcgggtgaacaactcatgactcttgcggctagcagatcatgcaaggagaagatccaggccagcagcactgggatccagcgctggtttgcggcgcgataggatgcaatgagagccagtggcagaggctcatgcaataattagagcctgaaaatcaagtagacccctacctcgatgagtgatcctcgatcccgagaccgagttgctgcagcgaagccggaaattcgggggatacctggcaggtacttcggtctcagttgccacggccagccaccacgagtccgcgagcgccctgtgacgtaaagcgcggcaggggcctgggccaagttcgggtggcgcagaagccaatcaacggcggccatgcgcaagctacagccactgaccattacaccatctgccgctgcggttagcctcgcttggcgtacctcacctcacagcttgtagtcgccaagtaccggcggttatgctacattagtaacctccatccagtctccatcacgatgaaccactccccacccccttcactcaacttcaatatttgctgtttgttttccatcctttgatgctcccgcctgtgctgcagaggcgagtagcactgtcgccgcatctgcagtttcaatggcttccgacaagagaacagccgacgaggccgcagacatcggcctcccgcccatcggccctgtcgcatccaccggctacctcgccccaaacccaggcgagagttcgagagcacagcaccagggcctgagcccatcgccgtcgcaagtatccctccagcccgcgactccctccgcgaggagtgatgttggccctaccgaatacttccccccactgcgcgacacaccctccttccaacagggatcgcggcctacctcgtcctcaggcttcccgggcttctcgggcgtctacgcacccgacgagcctcccacgcctggctctcgccgaccgagcattcgcattcgccgacgcggttcgtcgaccagctcgagacctaacagcatcgccgaacaaaacaactttctccgatcgcttgcagacagtgggaatcggagcaccagccatagaaacgatgacttttccggacgtccgcgtagcatatcgcagcccgagcgtactcacatggccccggagtcttcgcacctaggccgtgcctccaggcgggcgccccaaatctcgatgccccgactcaccgaggaaggggcgcggccaacgatggaggagctgggtctccaggacgagcctctgtcgccggttcactcattaccagagcagaatctgagccggcagaggacgacgccagagatgtcttcccagggcccgatgttgagacgcatgcgtgcggtcagccgcttattcaagcctggcaagcgccaggatgggcaagaatcatcagacgtggaagcagccaacgcgccgccgcccccatcgcgtcgcgggaatcgcaatagtcgtatcgatgatgagtatgatgaattgttggttgactatctcgacacaattggtaaatcccccctcccggcttctctgcaatatcctttgtttgctgtattttcctgggactaggttgctaacacgtttcaagacccggagatccagaccctttccaccctcacaaacgtccagaattcactcttcattcccgatcttggcagctgggtcaaccgccggccaacttacaacctatcccgaaatgatattgacccacgactgccaagacctgtaactgccacggaaccgcctgggatacttccaggggaacggatcgagcctactgacatggccgaagaccaggggcctcctcaactggaccgttcaaacaccatctcatcacgactcacggattcacactacgccgctctcccacacggcgccagcttggaaggatggacagaggacgagaagtgggaactggacgatcatgtccgccatatgcttcactcgcggcggtcgagattcaagcgttctatgaagggctttggccagtacgtgagacgcccgctcgggttcttggtcaccctatacgcgacactcatcaccctctttggtttggcctgggtactgttcctgatcgggtggatctacgttggtgacaagcaattgtatgtcatccatatcattgacagcgtacttgtcgcactttttgccgtcatgggtgacggactggctccattcagagccattgatacttaccacatgatctacattgtccactacgcgcgcatcgtcaagaaagcgcagacaaaaggccgacctaaacccaaacgcaagtggtggtggcagaagagcgagccgacgcagcagcctcaagatgccgcacccgatcctgctacagcccagctcccggaggtgacgagccccgagactgtcgattcgcgagactcggatagcaagagcgagcaggatccccacacccggagaaacaacattgttgacgttgacgtcgaggacgccaggtcagggattgaggtgtacgaggatacgccgctgacgtacgctcagcagcagaagctgtatcaccaccagacgaagctggccaagtcccacagcttctacaagcccaacgagacgaacacgcactacgccttcccgatcgactacctcatcgccatcgtcattctcctcgactgccattcgtgcttgcagatctcgctgggcgcctgtacctggggcatagactatcacgtcaggcctattgccatcaccacggtgatcctctgtgtcagcataacctgcaacatcaccgcggggctcatcatcaccatcggagaccgcaagacgcgcaagaaggaggtctggaagctcatgaaccgccaggagctgacgggagacgcgatgaagcacattgagcagaagaggacgaccgggcagctgtcccccgaaaagagcacggggtcggactcggataaggagcccttgtcccagaaggcgaagcggttcgtctcgctcatcgtcgaggagccggagaaggagaaggagatggagaaggaggcggagaagccgaaagagaacggtggttccaagcagccccagcgggtggcgtaaacgagtctcgatgtgacgggaaagcaaggcgtccaggaagcatgatgattatatctttctgttggaaaaaaaatctttttactctctctcccatcgcttacgttgatgcattcggtcgctctgagcgtttttaatattggatgactgttttggacaatacacataggatagttgacgtagttttaataagtgtccagaggcaagggggttgtataatcccctatagatgcctctgagacacttttttgttctggaaatcatgttcattcattcctatcttcaactatgtacactcctaaagaaatgattgacaacgaaacgcaaacagaaagggaaagctaagacaccagagagttgacatagttctccaggttcgtgtacccattggacgcgatggccatgccgtccgacttgtcgttggggttgagcccgttggccgactcccacgcgtcggggatgccgtcgccgtccgtgtccgtgggtgacgtgccgccgctgatggatccgggcccgcccatggaggcctcgtcggagatgagggcgcccttggtgccgtacgagcggacctggtcgacgagggcggcgtcgacggcgtcgcgggaggggaaggtggtgccggcgctgttgaggacgacggggacggcctcggtggcggtgtagagcttcgagggggcggcgtagttgtagggggacgcctggaagtcgatgctggagtagcaggtgtccttctcgcagagggcggagccgtcgagggcgccgttcctgttggagtcgtagaagttgtccttgacgtctggggttttttgacatgttagcttgtttgttactggctggcgaaggggttgggggttgggagttggggttttagagggatgtttacaggcgtggaagttggcgttgccgcgtgtgaaggcagtgacggaggttgaagggccggagatgaagtagttgttgatgatgttggcgtagctttggccgtcgctgtcgccggcgatgtagccaccgccgccaccccagttgtagacgacctgaattatccaatgttagtttatgaattcctgtatattttggttcctggatgcttacgttgttctggaagtcgttaacacccttgaccttggggtttctggtcttgttgtcaatgtagaggtttctgaagagactgatgccgccgtcggtctgcatgaggccaccgcaggagtgcgtctcgagaccctgcgcgatgatggagttctggatagtcatgtcctcggcatcaccgctgatggagaaggtctcgtcacggccccacgagacgctgacatgatcgaagatcatgcgagcgcccgaggcgatggtgatggcgtccttgcccgaggtgccgcccttgcccatgcggatgcggatgtagcggacgatggagtcgttggcatcggaccaagaccagccatcgccgtagacggtgatgccctgagagtttgtaagttcaggctggagaaattcgaaaggggaagggaaaagaaacatacacctccgggggcagtctggccggcaatatagacgccggacttgacgacaatccgagaggagatgttgatgacgcctccaaccgtgaagacgacgatgcggttggactgcgacacggcatcacgaagcgaccccgttccggaatcactagcaagtttctgttctcagccatctataacccccggcaaacgcggcaccgttcatccagagtggaagtttcttacttgagattcgtcaccttgtagaccgaacctgtgcgcccgccctttgcatagcggccgagaccctcggcgccggggaaggcaagctgctggccggcaacagcgttgagcaggagcgcgaagatgggtagcgacagtttcatggtgggtatcggacggtcgtctcacaagagtctcgggtggtgacttgaggaccaaacaagggggtttctcgccattctgggccggaactctcttatataccaaccaagcctctgccagggttcccaaaagaatgcgttccagttgaagctccgtggtttttaccaatctggaaggatcccagtcttggtattgcgggtaaatgcattgggcttgtttcggggatccttgtgtttcgtgggatttccgacccgattggtggaaggggggtcatggagctgggcagggatgtgtttgtttgggggaactgagatgcgaaacgaacgaccgagggtctgcatttgagagacgggacggtctgatttatcctccaagaggattgcaaggggatataacaagacgtttaaaaacccgtcgggatgaatgcttcatcaagaaaggtggcacagggccaaggtggttatactctcctgcttccactatcgagagggaaaacagacggtacgtacattgatagagaaggcgagatgaaaatcgaatagtacgatattgggcagtaactggacaagggtaggtgagttttcaatcttgttattgaggggtttctctgggctgtccaacttaaacccaagcgtgattcttgacccatgttgcagggctgttggctgcccgagaccgtctgcgggcacgcgtccagcctgttttatcataaaatcaggcatctatactggttcgcctgctcctggccggtggcgatgtgccaatggcaatgcaatcagtgacaccgtgacacccggcggctcggaggtcggctggataagactaaataaaacagaagatgggtgtgcgtggaacaaagctgtgagacatagactgcccaatggcttctccagcatggttatacagttctctctctcctcttgttgtcttctctccattgtaggggtctgtgtttctcgtctcccggataggctgggagtcactcaaggacgaactcgagggttgccaggcaaacaaatatagccagatctacgaatgaaaaccaagttaattttaaactcccgtgtgaaaaagaaaagaacgacaggcagcgaatagacaggggatgccagtgcgtgaggtctgtaccagtggatgcgtttaagcattgttgccgtgacacaagaatctcgatgggcattagggcaggcaacaggcatacttgcatccgcgagcgggacgctattgatggcatgagaaagccacggccctctttatgtgtgagcagtggccctatatgaagttgagctggcccttccccccccaaggctgccctatatcagatgagttcatcccaccttcttgctctgaatagattagtctcgaagaagaaaatcactgtaacaaaggtaagaaagagacctacctacacggccttatgcacacatctaataacattaacatatcccagccgaggatagccagtatccagaaagggacctaaagagaacggggtttcccaaaaagaacgaaaggaccgactcgaaaagacaaaggcaaaggcaacagaacaaaacgaaacaggacgagacctcagccatgtgcaactggaacacttacacattcgactgtggctgcatgtcgatggatctgcgatcgcgatgccagcgcaagctcgccgacgacgagctggacccgtgcttctggatgcagcgcgtcagcgacaagtggagattccaccagcagaggatgtgcgacgcctgcaactaccggctgatgcacggcgagtacgtgccgatgaggaagcaggccagatggagcgagattggggcgagggcgcatgagatagcgtggctcatggcgagggctagacagctgggttgatggccctaagtggtttttattcatcatagcaacggctttaacttggattctaaagattggctgcgagaaaaggagagaagaagatgagtgtctggtattggagacgcaaaagtacatgaaagggagggaagaaaaatcggtggtggtctaaagaggatgtgaggttttccatcggtcgaggatcaagtcaataccaatcaattaggtagttacaattaaatcctcgccctacagccctacaggcaatgtaacggaaacgcagttgctgtgacctcattatcaacgggctgtgggataacaagagagaagaggcatgcaaggagacacgcgactgcgcatgcaactgtggatacaaatcgcagatggagaacgagaatacgtaggtccaagactatttggaaatagcctgccgcaaactgccctatcaaccagccagacaaaaattaggactctcttttctctccattggaaacgcagagtccgtaatcgataagtgccctcgttaaactgcctggtgaggtcactgttacctgttaccgacgtctcgctagcaggggcccctattaaggacccctaaaaagatcctgccgcgcggcttcacgcctgtgcgatttgtgatgttggctgcatcgcgtaactgcttctcgcagctggccgtagaacaggagcacgagcaggcacccgagcaagaactatctggagctgaatcctggcaatacgacctcgtccatacacacttgacacacgtctggcagaaccaggcccctgatcaagagcagccgcagcactcgatggcccccccacccgcccctctaagtctggcgcggcattggccagttgcgacttggcgtagcggaataattctgggtacaaggggaaaacaccatcgctggcggtgctcgaccccttcataggcttgcatctggtcctcgacgcatcccctcccgcctccatcgtcattccttcctttgccatattttctcttatattcaccatcttcaattgcgtctcctccctgacgtattccctcctaccaattttgatctcgacattcgtcttccattccgattcgtggcctgtcgccgtcctcaaccccttgtccgccgcaagccatagcgggcttccattatggcgttagggaggacgagatggctggtggtggccctcgccatcgtcaccaccttctacgtatttcacagctccctcctaaacttcaactttagctccgggtcccatggcctgccgaagcccctcgcccccgtcccgataccagagccggacaagacgtatctttggcgcaaagtcgaatatcacaaccccgtcgagtcctaccgaccgctccccgaaccaccaaccgcttccttgcctcgtgtccaggccaagttctacactggcggatccagccaggagagccgccgaaatgccatcaaggatgcatttgtcagtgcctggtcgacatacaagcaccatgcgtggttgcgcgatgaggtcacgcctgtcaccggcaagcaaaaggatacattcggcggatggggtgccaccctggtcgactccctcgacactctttggatcatgggtttcgtcgacgagttcaaccaggccgttgacgccatcgatcgcgagatcacctttgagagtaccaacctgaaggaggtcaacatcttcgagaccaatatccgattcctcggcggactcctctctgcctacgacctcagcgccgacccacgtctgatcaagaaggcccgcgacgttggtgacatgttgtacaaggccttcgacacccccaagcacttgcccatcgcccgctggaacctgaaggctgccgcccagggcacgaagcaggacgattcgttcctacttgtttccgagctgggctctctgttcctggagttcacccgactgagccttttgaccaatgaccccaaatactacgacgctatccagcgcatcaccgacatgtttgctgaggcacagatgaccaccaagatcccgggtttatgggctcacggcacctcgcctgctgagggcaaggttgacatcgccaaggactactctcttggttccacatccgacagcttgtacgagtacctgatcaagatgactgctttactgggcaacacccagggcgtctacggtgacatgtatgccaagagcgtcgaggccattatgaaacaccttatctaccgacccatgacccccaacggtgacgatatcctcttctcagggtctgcccagtcggtcaagaacaagaaggacggttccccagagattaggctcgacaccaccgcctctcacacggcatgctcggcgggtggtatgttcgctcttggcgggcgcttgctggcgaacgagtcccaagtcgctaccggtgccaagctcactaccgggtgcgcctgggcctaccagagcatgacctcaggcgtgatgcccgagtcgctctacttcaggtcctgcccttctctggagccctgcctctgggatgactctaagtggcacgagggtatcattaagcagacgtccagcagagacgtgaagaagaccatcctggaagagcgtcttcccaagggcatcacgcgcattacggaccctcgctacctcctccgccctgaagccattgagagtgtcttcatcttgttccgcaccaccggcaactcgcactggcgggacgtggcctgggatatgtggcaggccatcgacaagctgaccaggactaagctggcaaacagcgcagtgcgcgatgtcaaccctaagggggagaagaccccccaggagctggaggaggaaaagaaggagggcaagaccaccgacaaggacagcgagaccgacaaggatgtggccggcaagctggactccatggacagctattggacggcggagaccctcaagtacttttacttgatcttctccgagtcgagcctcgtcagcctggacgactgggtatttaatacggagggacaccccttgagaagggcgcaagcacatgcgtaaaaaagaaacgaaaatactaagttatgttttttgtataaatcacattttcaacaaaaaaggcgacatagccacgaacaaagtcctatacgaaattgacgcttggagtcttgtatgtttgcttcttcagcaggttattggtggtcataaacacacggtgtgaaggttggttccgatttgtggatatacaggagagttatattatgaattatcaaaattggttaatacacactcaaaaggcatgctttattgctttcttaatatctattcgtatttgctaacattagataagtccccccccttttcataatttttcacacatataccctccactactcgttcgtactcacacactaatagtcagtgctgcggatgacatccttccactcttccaagataccctcggtctgcttgatcttgccacgaatagtctcctcgcagtccgtcccgaggacgatcctcacgggcagcttcttcccctcggcaacaccagtacccgtcaggatgtccacgatggtcttgccccccttgacgacatcaccgggctggttgccgtccgtggtcagcagcgcagcgcggacctgacccgccgccgacgacgggtcctcgtaggcgggcaggcgctccttggaggtgaccttggcgcccgggttgaggaaccccgtgcggaagtagcccggctcgacgacggtggcgcggatgccgtagctggcgacctcggcggcgagggactccatgagcgcggagcaggaccacttggtcatggcgtagacgccgtaggtggggccgccgatccagctgcccaggctgccgaaggcgacgagggtggccctggtttctgtgctgtcgaggggcggctgggcgcgcaggtgggggaggaacgccttgatggtggcgacggcgccgaagacgtttgtgttgaaggcgtcgaagatctcctggggggtggcctcctcgatggcggcgtcgaggatgtagcccgcggcgttgatgaggtagtcgacgcggccgaagcgggcgatcacgtcgtcggccacggccttgagggtggtcgggtcggcggtgacgtcgagggcgagggtgtgggcgccggcgtcgcggaggtgggcgatgcggtccgcgttgcgggcggtggcgacgacggtgtggccgcgctggagggcctggagggcgatctcgcggccaaagccggaggaggcggcggtgatgaaccagactggggtggtcatgatgtcttgtaagcgtgtaagcgtgtaagtgaggaggaggtggtggtggtggatctggtgatgaagcaggtgtatcggatttttcaagttttgaaggaggaacagtcaagagtagccaattgatgcagatgattgtatttcatcttcattttgtctcattattgccttgatttatatactttgtctcttggttgaggttccggccagtgtgagcttaagtccgaggaagctcttggcgatttggagtttacggacgtgatattaaaaattgggctagttgaccataagtgggttgcattagagcgtaagcgccctgcatagatatgatggatctctgtatcgtccgagcgcctttatttagggctggcagtctggggcggcatttgggtggtggaatgtgacgtgaagccggagatgacgtctgaccttgatctcgaagcgaggtgtgtctaccacaaatggtcagtccgggcagcataaaatccgaagccatggaaatgtaactatgattagcaagcaatccagtatgccttgcagacagaatcgtttgaatctggaagtaaaacggttgccctcaacctcagtcacgttctcgtggaggcatagcaatatcacacgctggaaatgacccctcactgtccaactacaggtggaagtctcctctcctctcaaatcaacaacttcgcgcctgtctttgcctcgaatggcagactgctatcttatccggcaaaatacacctctcccctcgggcccaatcagactgatgatcatgggctctatcgtccagctgcgtggtccctgtataggaaggtagcggtgataatcaagcaagagaattgcatgggccatctccatccccctcactagcctctcgtgcttctgagcgatcccacgtctattccgtcctctcccagcgtgctgcatcgccaaaggaggccaattcaatagaaaaataatccgtcgcccacaatgatcatcaagcagctcctccccctcgcattggcgaacgcagccctcgtcgcggccgcccccccttcctccaaggtcctccccttcgtcatcaacacctggggcggccccttcaccgccgccacggacgcggccttcctcgcgctgcacaggtcaaacggctcaaccagcgccctggacgccgtcgagatcggctgcaccacctgcgaggacaaccagtgcgacggcagcgtcggcttcggcggctcgcccgacgaggactgcgagaccaccctcgacgccatgatcatggacggcaccaccatgaagtcgggcgccgtcgccgccctccgccgcgtcaagcacgccgcctccgtcgcccgcgccgtcctcgagcacacttcccacaccctcctcgccggcgacctggccaccgccttcgccgtccagaacggcttcgcggaggaggacctcaccaccccggcctccctcgagaagtgcacgtcctggcgcgccgccagctgccagcccaactaccgcctcaacgtctccccggaccccgaggcctcctgtggcccctacgcgcccttgagacagctcgcaacgaggatcgatacccgccaggcctcccacgacaccatctccctcatcgccatccaccaggacggctccatggcggcgggcacctccaccaacggcgcctcgcacaaggtccccggccgcgtcggcgatgggcccatcaccggctccggctcctacgtcgacggtgacgtgggcggctgcggcgccacgggggacggcgacatcatgatgcgcttcctgccgtgctaccaggccgtcgagaacctgcggcggggcatggcgccgaaggaggcggcggaggatgccgtgcggcgcatggtcagcaagtaccccgaggtgtcgagcggcatcgtcgtcgtcgacaaggacgggaaccacggcggcgccgccagcgggtggacgtttacgtacgcctaccgcggagggtctatgaaggagactgtggttgtttcagtcgagcctgttgagagtttgcgtcgggagctgtgatcggccccgacgtgcattgtatttcacctcatctgacatcacaatatttgcgagcgtgtccaaatgtgagttcggccatcacaaaactggcccaatagaagtcaagtgattgtattcaaaatcttgctgctatctagtgactgtagaaaaaatctcatcaaaatttgaaacatgattttgaagagaataaactgagatactcctgtaagttcaatgtaaatcttctactcttctaaactgtcatgacccaaccagggtcgaaacgccaataatgcaagaaggatggaggaaagtatatccaataaccatccatctgtagatccctttcctaatttctgaatgataaaagccccggtgagatcaagtctcaatgcaaaatatatgtaagccaagaagaagtattgtcaaggccagagtgcgaaaacaagtgcgaaacattggaggctgagagctggaaaagaccaaaacgcaaagtacagatgccatgattgagcgccatgttgatggccatattacacgcggacctcgcttctgttcttgtccttgaacaaggctttgagcatattgctgccctgtctgtggatcttgggccggaaatcaagatcgtcgtcgcctctttggctgcgcccatcctcaatgagcttgggagtagatcgttcccttctggtgctagacgtcttcctacttcgctcgctgccagcgacactttcggctgtgtgatgcctggtgcttctgcggtccgagtcatcctcacgcctcgaccttgaggtcttgcttgtcttgcttgtcttggcggtcttggtggtcccagtcgttcgtgtacttcgtcgggaccggacatcgaagtcatcgtccttcatcgactttgtcgcacggtcggctgtcggagtaatcaactctagatcggcgctctcgtcatcgccgtaagcagggacaccccgcatccacgtctcaatagagctaagctcgtcatctacaatgagagcttcgtccacaccaaaactgtattcactctgcgtcctcataggcgcagggcgattcattggcacgccctcgtatgccatcgcctccctggcggcagcttgctccttcaccctcttcacgatcttccagccaccaaacataatgacggtcaggcccacgacggcgccggtgccaatcatgaactgcggcgacgccaatagaccccagacggccggggaaccgcccttgagcatggcaagaaccgccggggaagccttggtaacaaccttggaaagctcggcaagcgtgcatgccaccgccgcagctgcatctgggttcgtctgcaggtgggcgatggtttttccagccgagtatttcaggcagttggcttcgaccagaaggccctcgaccctcttggtcagagccttcgcttgatactcatctccatagaccggatcgagatcataacgttcgtgcaggtcaggcgggagctcaccataagcgaggttcatgtcaatctccttggcgggagctcggatcaactggcggtcttggtcatatgggctgcggctaccgacctctgaatatgatgcccgtcgagttagggcagtcggtggtggcctgcgttccgatactgcgaggtcgcgcatctgcgcgtttgttacatccatcttggacaacgccatggtctcggcgtagggccgttggtaggtcgagggaggtggcctactgggtgccgtggcagagacctgggtcatggctttgaggtttttctcagtcagagctgaccctcggcttgtggtgctaccgccatactggctctcctcgtcttcacggcgatgtgtgcgcttggagactacgctcctcgatcggcggctggttctcctggagcttgcctcgcttcgtgcgtcatgacctcggtggctgcgttcctcgtggtatctatagtggtggtcgtcatcctcctcctctgcatagtcatggtgatggtggtggcggtgaaggcttcgggtgctttggttgacgttttggtcaaaggttgccgcgcgggtgagcgcccggtccgatttgagctgcgacctcttgtccttgtaggcctcttgcgcttccttgaagactgagaggagagttttaccctgcgacacaggttggttagctattgggaggggcgcaaagggatgtggtgaacaaggagcggggccgtaccgtgccaataatcttgcccgagttgttcagaatggtgacagtctgttggagaggcatcttgcttgctactcagctcaacggcgaaccgatcggcgctgagaaacagtccaaggcagtagatataaatgtgacaagccggcctgcagcgtctagaacaaaaataactctgcgagggcactgcgcgcactgcaaagcttccccccagcgagaacggttggggccaagcgagccggagtgacggtgagaaaaccggctggcagtccacagagatctgctgctagtgctgtttagtataacttcacagtccccgccagcagaaggggagcagggttatgtccctgttgaaggaacccacagtgaactgatcagtgataatgcgatggatgcgcaatgggctgaccctttttttccctttcgctagcgaactagctgattgcagccggggtcaattagggaccatatggattttgtcggtcaagaaagtaggaggtgggaaggatggagtcaggcaagtcgtggtggtagtaggaacagggaggtgagcggaagacgagagaatcgggtatctcggttctcaattatcagcagtgtagttaacgggaagcttgggaaggtgcggccatcttattctttccttgctggcaggatgcggcctgaattagtcttataagtagaaacaggcacttgggggctagtcaaatgcacacctatcgctgtgttgacctgtgtgatggcagcccaatcacctcacctatcacccgctgcagagagcccgccctgggagtctggctcgatcctcaaacattcaggcatgcgcaccgcacccgcagacgcaccgcacaccctccctccctcccaggcccaggcgacacgccgaggtcgtcgtcaccgttccagccactgaggcaacccgccgtacagggcaccaggactgcctgtagccagcgggtacgtaccgcctcgctgcccacggtggagcgacggcctgcctcctcccgctccctgctgctgcctctgcctcctactgttgaggcccagaaagaccatcccactctgcctcagatcccgattggacgctggcagccagtttcctcccccgttaggcgcttgcgcatggccaggttatgactggacgccagactgacaagtggtacctgcgacaccctatgaaaattggcggggctggcaagtacccacggctaactcaggcggtcggcgacaagccaagactactgcgaatcccccgtagtcttgcccagtcgtctctcgatgccctgcataaaggtcacagcggttgtcttgtcaaacacccaggcctgttgggcacccactggagctagaggtgagccaagcgcacccaaaccgctcacccgcgtctccccggtctcgctcgcttggtcatcgtcggtggctgacgaggtgagtctgcgcgagagcctgacgagctccggggtggtggaatcggcgagattctgggagtggaaagacaccccaaagtcccacggtattggacggggagggagggggaggggcttgaaccaaagcggatcagctggacaggtatcttgagagtcgtccgcatgcccactccaggtctttcatcagcttggcatgcccattcttcgttatctgtgaatggaccgcggggtggatgccttcgccagtggcgacccagtaccgccaaagtgcacttctggtcaagaccaattcgatcgcctccttcatctgtgcccatgtgctatgcacgcatcgagtaaaggcttagcccgtctgatcgtctcgaccttcattgcgggtacctacacgcgcgttatcgccttcacgcgcggcgcagagctacgggtccgatgctcagcgtgtctaagcacggagagtacccggatttgggtgaaaatggatgtcctgatccaatggagcggtggtttgatcatcgccaacgctacatccgcacacgccggctcgccatccgccaccacccagtccctacctctaaacaacctacttcctggtcagaccctccaattgtggctttcgtaaatcaccccggccgtaatactcaatcattatgaagtgatgctacggaacattcgacttatcggtaggaagagtcccttgctcacggtccggtcgttccgttctcgcacctgatgtttcgagatgagatccgagacacggctcaatatcttcgtcgtcatcctgcagctacagaaggcattattacgctcaactacatgttatatccaagaatgcatctttcgatgcgactctaggtaagatttggcgcacccagaatcggatgcaaggttacccctggcatcatcggcgcgctgcataacacaccccgactcttagggaaagcttgcagccgtgagctttggggaaggccccattcttaatatccatcagtcccttgatttttgtgaaacggcggaaatttcctggcgttcggcttcgtgatcataaccgatgccaccgccagcggtgaatggaagccacgcgaggcggtctggtaccagcctccgtcttaacacgaaggggccgtaaccgggagaacgcccagccattcctgtcaccgactcgttggtaagccttgtatatacatgcacggtatttatgatagatcgttcctgggcttggcacaaaatgccgtgctctcctctcttgcccctccatgcgtgagctatgtacatgcactcacctacattaacatgcagtaggaccaatgtccaatgacataggtgactagagactcgcaacagaatgataggtctcaccaatgggcctaccaattagaatggtgtagtcatgtacaattacgtgagaggcagcatcagcaccacttttcgacgacggtctaaatccagcaaactactccaactggctgacaggtaatcagtatttctgcccaacactcagcatcgggccaactcacaccccccgagggaacgagaatacggtttggttgacgcactggaaaagacgtcccatgatcaaagtctcattcatcatacacctggatgaagcttagctcagacgcagttaccactgccttaaccgtccggctgcatccattgatatctgactccacctatgaagcagttcggtatagttacccttttgacgcgcatataataattatggcatattgggaaggttgaaacatggaaaaagaaaggaaggttagagggaatttcattctcatggcacgtatctaggtttcatgtcgagtgacctgaaaagccatcctgagtaggaaaattgatgacgtgctactacttcgagtctccaagcaatgacacttcatgcggatttctcatcaactaatacatgttgaattcaaagatgatatgcaatactatgttgtttgcttgtacatgtttggttgtatgcatattcgatatcgatatcaatgtcgttttggcaccagttcctgatgttgtaacatctggagtctagaaaagagcatttcaaatacaaaacgaaaataagagagtgggttacaatcatctacatccagctttgccgaggtgttatatgtcgccctaaaactagcatgagtttctgtctcatgcaacccgcccatttgcagcattgattgggcagatcaccaacgccagtttcacggatcaaatggcatccgcgtctctaaaattaacttcatatcggcattaatcccttttctgagaaaatgccaggcaatgggacccgagtgtcctcctcaagcgcacatagccgatccagcaccggtttcactcatcgactctggtggtaaaaggtgagcaatggtttctttctgaaactcattagcctcgttggcaatttgagggacgagtgaatctctgagcacacaattatgttcacggtaagtgaatacacctgctcgcgcgtgacagcagcgccctttagtatggaactcatcgataacacccactcgccaactccctcagtatccatcacaccagagaagccaaagctcaccagtcggtgatcagaaaatctctttttacactcaatccatcttccacatacatttgctgcttggtcatggacggcgggccaagtatcgactcagatctaaggcattactagtgctatcttcttgcgcttctgattccgatagagacgaatctccctagtcccctcaaacctctaacctttctccccctaacgatatgataatcaacgcttgactactaagatagatggccatatttccggctcgcgaacatgttcagaaacgattagcataactgtcaacttttgggacctagaaccctgaaattgacgaaaaagataccaggcagacttgatagctcgcttcaaagtttaacaaaaaagaatacccctggcttagtataaagagaacaaggcacacttcttgtgccgtctccattttcttgcaaaacttgatgtaaaacggtggccgcgaccgcaaacttcgggctcttaccagttatgtgacgaacacctttagttaaatgcgcccacctgcctcgaaacaaacttcaatcccttggctgttcttgttggtgcgctacagattgttgggatagaataatgtagtcgcgctacaaagtatcaaagggttctcatccacatcttgcagggaagtcggcactaactcgccgtccctgtcggtcaaagactatatatagatatatatatacattcagataaatcgttgagctcattccgtaccatagtagcatactcccttatgtgaatgggttcttcacctacttaaaacctacctaggctaatttgtccgtatgccgacctctggatcttctccgttacgttcctccaagccgtcgcccgttgtgtgatgatctgaacctgtacgaaagatcaggtacgccgtattcgttaatgaaatacctgcttatatatgcttgaagggagctccggttgtgggtagatatatagtggaataatacaggccacgacacttttaaaacagagcttatggcagtctcggatgagtgaaaggtccatcttttttgtcttttcttattgttgaggcattcgagactgagtggaagagcgaggcttgatctttacttcttcaacaattgtagcaccgcaatttcaacaatggttacgcagtatgtggtgagatgtccatgtacgacatggataagctccgcgctgtgtcgtcacgttctatttcctctgctatccttcccgtggatccctaagcagctctgtttgctaaggaagtgccaagaaccaggattgcacaactagctaagatgatggtgataccatacctcaacatcaattacgagctcgggatgagtcttacacatgctgtacgatatggtaaaatgagccaccgattttggcgcgcccagcggtgtgatggtgctatcgaacgataatagcaccctgctcatttgattaggttattttgcgcgtgtattgcagaagtcagcaggagaccgcgataatcaagggcacctggttcatgttgtaccagtctacatcgcgaagtctatttcaggctctgggttagatggccactactcctaccgtacgcactgaccaaagatgtgatcccttttttttcgtaaacattgcatagtctggcttttctttctggttcggtggccaagatatgaacttgccaaaatggtgtacggtaacagcgatgagtgcactcaatacaaccctagcaaagtcgtgcttcatgttcctttttttctcgatctgtcgctctggtagccagatcccatcctctcaagttagcatggatgtcgccagccaccaattacaagctaaaacagtgactgggtattcggggtggaggtcgggtcgggcgtgggcggggatttgcaaaacaggtatacaggacagacgacacacaacacacttgacgcaccccgttcaatgctctttgcttttacatcgtattaactgcgccacggcggcttctggtgtgctcatgtttggggtggctgccatctcctaacctgctcctccattctaagccaatgagccagccaaatagctcggcattggggacagattcttggccgcagccaaccacccctcagtagcggatcagcagggacgctaaacgcgatgtttggcacctaggggaagactacaggccactagcgctcctgcagcacgatttccaagcgaatgttgctgagatgttcatggtcttgcgccactctcgagcagctctttctcttgccagggatcaacctgattcagccctgcaactaccgtagcaatatggaaaaggggacttgcgaaagcccgtctgcgatccctgctcaaacggcaaggccaatgaggtgctacagttgtgcttacatgaaaggtaaatcgtaacctgcggctggtcgaatgtaagaccacgtgatttgggcttcctaggtcgggcgacaggccaatcagagggcgcatctaaaattactctcagccatgccgtttcgctcctagccaagcacatcagcccggatcgtacaggggaggagacgctatcagacctgctacgacccagccccggagagattttgggacttgcacggcaatccctggggctgagattcacaaccaacgggctggatcggccccattgaccactgactggtcgcgatcgaaggcggccttttccagctagccagctaactccgtgccgtgcttatggattggccctcccactggtgtgcttgatccaatcaagcctgcaattctttcctgccgcacgctcccgtcccctggcttgtgcacccagagaaagccctcggcgccacgacccagctctccttcccttttcctttcaccacccatcatttaccagcacactcgttttgatagccaacgcactgcgagcgcgcgtctagtctcggttggatctggattcttagcttgagccagagggataacattcgcttgctctcgtttctccccttgtgtgcccagcctaccaccccaagcccccacctgtatatcatttggtggctttctgagtatcgaaaccgatcatggctcgacgaagtgtacagtggaccgcgtcgctgctctgtgtgttcctctttgccgggtcagccctcggtctcgagaatgacttcagtttttaccccagcggcgcgcagagctgtctcacccaggcagcaaaccagtcgaaatgttctgggagtgacgcagccgccatgaacacctgcctctgtggcaatggaggcaatttcatcaccaatgccgccgcgtgtattgggaagaactcgtccggcgatgtcaagaatacctacgacgtaatgcagaaggcctgctcgacctcaggcacccccatggaggtcagccaggccgacttcatgtctgcagcatctggaaccacaaccaccaagacgacctcgacgacaaagacagcttcatcttcgaccaaaacggcaacttctactgatgctgccaccacaacaaccagcgcccaagcaaccgctactaccacctcgccagccgaatcatcctcaagttctagcgataagggaggtctgtcccagggtgcgaccattggtatcagtgtcggtgcttctgttgggggcgtcgccatcattgcaatcatcgccttcatcctcttccgtcgctaccgtcgccgtggccctgagtcggaccccatgctcccaacccgcaccaacatgccgacgagctatccagaaggaggatttgctagctacaatgacttcaagtcgcaaactcacagcccggcccctactgcgccaacttcaatcgcaacccccgcctcgtgggtcactccttcgacgccgtcattccagggccacccgcacccggcatacgcaccgcacggaggatatgcgcaacatcaacctccggtggcagagctggcatcggacgcgttgcctgggaacaccacattttcggcagtagaaatgcctggatccattcctcagggacggaggtgatgcggtttccttgagcgaaggaagagttttccaacaaccttgatttacgagcgactgaaaataaacgaaagcggagggcagggattatcgaccacatatgatctgggcgtttgtctcgaggcggaaccaggcatgaggccagggacaggacatttaatatatccggcttaggtgcaattggcgtcattgtgttttggcattgtttctctcgcgttgactggatttggcctatcttaatgtatattggttttgcacatggttcgagccttggagggtatggcatttttttcaactggcatccctgtatataaattctgctttgacagcaggttttcaaatccagagataaagaatatttcaacatccaaagttccaagatgccgtgatgggacgcatccttataggtcaaatcatcgtggtttggtttatccgcgacccttgccaggtcagcaaggtggattggctcgcggatgtaaccgccggcggtgatgggtcgcatcgtttgatttctacagaaatatcgccgaatacgtacctgcgttgccaacatgtggcaggcctgcacgatgctacatgggccgcgtggcgatataccgaccccgacacccaatgaaaccatctgttccgctcttttaaacaatcttatgtcggacacacgccaggcctcagttctcgtcacaggacatattaacccgtcgaaatcatgcggaaagggctaatgaaaatgagcagatgcacttccaggtgcttgtccatgccctctcttggagtatcaccgtcgaggcaccacaccccgaacctacctagagctgaatccaaccaagttgccaagtcatcacgactgctcgaagcccggcagtccttgagcaattaaacctgaaaggtttcagtgctgtccggctggatgtcaccaaccaagacagcatcgcacaatgcaagcgggggggccgaggagctcgcaggtggccatctcggcactctaatcaacaacgcgcaatcattcaacgacgagaaaatctaccaatgatttgtatccgatctacgcggcccagaagagtagcatcgagttgtcgccgtctcttgtactgacaagtgccccagcttcgacgaggagcttggatttgtcctccaagtaactgttatatgaagccagcgaaggggcccttggcccatcggaacttacaatattgacattaggtagttccataatcgatcaggaaaccctccaggatggcttaaaagaaaccttctctcaaacccaatggagagatgtccaacagcaatcatcttgcatgttgggtctgctgcgagactggacagccgatcaaccaaaaagaaaggtgaaagagagagaaaataatgcttgtgcccggatccgaaaggaccctagcccctgtaatgcacccgttctctccattaccttcgcaaggtatgaggaaactgcgggagttcaatagctcacgcagggcgagtacatcacaaggccagtcgtcggaacgcgctggccactgcgccacaggggctattgttcttgttgaatggagtgcccggggaacttgtatataaggtgttggcctctgcgggttggttgaggaccggcgagtccgtcgtggtcggcgcaaggcgcttgacggcggtgtgcccaagcgacgacggctatcaacgctcgatgctcctcacttagccaaaaggccgactaccttttgtgacctattccctgaggctgataaaagacctgcagacgctccgctatttctctcatcaatgtccgctccaggttcaagcagggcctccacaacgtccaagtgagaatgtgtcgaggctatgatgagtgatgtcatgccatctatgtgacaaacatagatatctgcctcgcaatcgagctccacaaccccttgatattctctccttgaagcaatcacgagtggagaagtttgaccgttgtgataaagcttcacatttgcccctttccaatgaaagcctcaccagcctcattattgtattggcgctggggagagagatgtcataccatcattgtctttagtactcaaatctgccgcatttcgaaatcagctcgggaggaagtctctttcctttgttttcctttggagattttggcatcagaagattcgtatgtgacccgtcttgctcggtctctagggatcactctttatttgtatactgccccatcgtcaaagcttctccataccgttttaaagcaacatgggtcaaggagctattacggtggaccaactccaagcaggcaataaacgggaaccttgatggtcagccgaaagaacggccccacccgggatcaaaccatcaaggttctcaacgcacactcttcgattccatcaggtacctcgatattccccagctgcgtttggccctgtcctctccctgaatgagttcccctgcgagaagaccggctctagcactatgcgttatttaagtttggtttgggctgatgtacagcacaaaaaaaggtttaaactttcccgtagcttacttgtaagcttaaggagttttaggtacaacttcaaaacgcaaagacgactcaccttgagaagcagtgtcacaagacttgagttttcttagatgatgccagtaactttttatttattaataggttaatgtcatagccttcaatatggctgactattttacccgtcatcccacgcatgagcttttgtaatatgtcaaaacagacaatcgatggtatcttattcctcctaggttatcattttacagagcaaatgccacagcagcgaaagctccggcaagaggaacaaactcagcagcagccataccaccctgggtggaggagctggcagcaccagtagaggtgccagagccagagacggcggcagtggtggcggggccgtcgcagtgccctgcgggtagaacgttagtatagaagccagggacgaggttattaggatcaaggtaacatacagtggtctccgtgaggctcacagccgacagactcggtagggctgggcttgaggctgccggtgccagcagcatcggtgtgggaagcagagggggtggtgactgaagcagcgccggtggcagggccagtgcagtgccagtggtcgccatggggctcgcatccggcagactcagtagggctaggcttcaagctggcagtgccagatgagtggtcatcgtcatcttcatgatcgtggctgtggctggcagtgacggaagcagagccggtagcagaagtgacggcaccggtttgtgtagcagggccctcgcagtgccagtgatcgccatggggctcacaaccgacagagttggtgggagaggggccagggttcacgctgctgctactctgggccaggccgaggggcaggaggccgaggccgaggagggcagtgaatgtagaggttctcataatgacgggtagggggagtgatggggtgttctagactcgaggcacgaggcacaacgtgatgcaaggctgagatgggatggcagaatagagattttagtcggcagggcagaacaaactacaggatgggtatttatacgtatcatgcagcaaggaaggttggtcctttgtgcctgctcccatgtaagtggtccatccttccttggattgggcttgaggcgtccgggcgaccctcttcagcccccacacgtttataactcaagatggcgagagtgtcagctcgaaacggtcgatacggacgccgtcttttgggtcggacccatgtttgcgttgaccaagacagtcgatgtgatttgctccggcgcgcaagaagcttgtggctgtcccgctgctggtctggctgcttattgccgcagccttcttggcaaaccatcaaggtgcaccacttgcaccgactttagccctttgagcagggcttcagacacgaaccaaataaaacgcacaaaaggacctgcctcgtctggtcggccgaacttgtgatttgcctccagactccattgaaatgccagcctcatcgtgatcggagtctcgagttcctgttttgtgttttctcttctcttctcttacttgtattatagtcggcccttcgttttttgacgaccacttaatatgcctgggccacagcttgtcgcgagacttcttgcctgttctgctctctgcctcaacatcgtcctatcacaaagtgaaaagcagccagaacttgccgccatcccgattatcaaggatggagaggtttgtaactattgatgataagccgtgagaagagaaatagaactctgacatttgacttcagcctcaatttgcatctgctgttgagccccctctaattcagccgacagaggttcgcaaagtcatcgtgaccatggagcagcctcgtgtaataccccacccagatacacctcgccataaagacgagaaggccaggctgctggaaaggctaccaaagaacaaaggcacttggaacggcaaccacgtacggcaccgtcttttagacgcactgtacggttttgtcaagtaccaagaacgacagaacgaggaattggtgcggctccgcggcctgtacaccaataccgccaaacatcagaaagcagtgagttgagtttgacgcccggcgagaagcacagcaagtattctgatgctctgatccagttattggagaagtttgtccaatactcggacaagttcacccaaatcgaaaagcttctggcaaagaaccaagagctctgcgaccgtattgtcgagtcagccctctccttttatgccattgaccgctcagagctcaatgagcacataaagaattcggaaaaggagggaaggaaggccgataagatttcagtatcacagtccttgaaacacattgttcgtgactggacagctgccgggggaacctacgaacgcgatgactgctttgcctgtcttaccggcgtccttgagaagctctatcccgaccgagatgaacggtcaaagccactcaagattttgctgccaggagccggaattgggcgcttggggcatgaaattgccgaactaggaggtaagagtttcaccaaaatggtcgtgatctgatgaacttccggaactgttattaatccctctgcaggcttcgaggtgaccataaatgagtggtcaatgtacatgaatgtcgcctaccgtttcctcgaaacccacggccatcgcaccaactccgagacattccatccgttcgtcgacctctggtctcatcacgccagcgccgccgacatgcaacgcccagtcaccttcccagatgcccctgtcaacgccagcgaggttcttctggtcgagggcgacttcaccacagtattcaacacgaaaccgtttcggcattatgacgtgattgtcacatacttcttcatcgacacagctcgcaaccttgcaagctatttcgacaccattgagacactcctccgtccagggggctactggatcaatttggggccacttctgtacggaactgcccccttcgttcaactgtctttggaggaaatcatcatctacgccgaggaaggtcttgggttcaagtttctggacgttgctgggtcagagtgtggcgagctcacatttccggatcgccatgtccgaggaatggaggcggcgtatggtttcaatgatcgagctttaaccaaaaatgcgtacaaggcgcaattctgggttgcacagcggccttgaggcgcgtgatgacgattctatagacttgtattgctgggcagctaatgttcttattactattccatgttgccatgatgcaatcaggacaggataacaaaaactatgagagggcgaattcctttagataataggagcaggtggcaaaataatgatcaatttcaataatgacaatgaatgcccatgtcaatgtagcctacagagacgatttccttcaaaatttgcctggttctagaccaaaactcctgtgctaatagcaagcattctccatgtctgctgatttgaatcccttttacgaacggacgccatccatgtatttgtacaacttagggcaaattgcccgccaagattcgtacaccatcaaagtttacagacgctcaaaaactttactgaagatctcccgtgccttgaacagattcaccatgcttagcctctcattgtccaagtgggctgagtcgctcgcttgcccacaaggtagatgcgccgccggagccccaaattctttttccaggaaccgaatagcgggaatggatccaccctcccgaatatatagaggcgttcttggcttgagggccttgacaggggagatggaccgggggagctcatctccattgagaacaggtgaaccagtctcgaagcaagcaggccacgcctcgatgatggcctgctccaaagtgcggaagatctcgttggttgggtctccgagccagggctctgctttattgtcgatgcaagttctaacccagttctgagaaccgatggccgcgaactcacggtccaagaattcagtgagctcacgggcaacatcgtctacctcttgtcctgggacaagtcgaaggctgatgtgtgcactagcctgcccactgatgagactgccatccgggccggaaaccttgtaccggtgaactgtaagattcggctcccgccacctggccatcagtgatcgcttcagcttatcctcagagatggactccgagctgcgtttaagcaaaatagaggcgatatcatcatagcgagcctcctcttctggagttagaggcgggattccatcgtagaaacccttcagctggatgcgattccctcgccctttcaatttggacagtagaagagttaaatcagatagaggttcgtccatcatgtacgaaccgtccacaccagaatgaatatcaggccaggaagattctacactgacggtggcatgcaaaacgccccgcaatccatatgtcaggcatggaacttcgtcgtccagccaatagctgttagcaagtaaaatgtagtccacgtcaccaatgagggccttgttgcttttaacgatgtcctcgaagcctctggatccgtactcctcttctccctcgataaggaaaatgacgtcgttctctaacttctgcgcttgcataagatctgtgacagcatatagggctgcaagaatcgggcccttattatcactcactcctcggccgtacaggtagccattcgtgcctgtaagcgtgaacgggtcattcgtccaagtgcccttcctgttgtcggcggccacgacgtcgtagtgcccgtagaaaaggatttgctttctgctgtcggatccttctgttttcccggaaaagcgagcatacacgactgggttgtgtgatgcattggtacgcagcatctcaacttgaccaccgagccgcttgaagagagctccgagataagttgcacccttgtgacagtcttcagcaaactcaggccgagacgaaacacttttaaaagcaacaaagtctttgagagtggacagcagaacatctgtgccttgttcaattgaagtaacagattggcagagatcttcaaacgtccatatggaaatattgttgtcattggctcccgtaatgaagagttgctcgtcgctaaaggaggtcgttgcagaggcaaggattttgccttggtgagctttccatcggctgaggcacttgtatttctggttgactttgcccaatgcagccgactgctggtatttgccataatgggcagtgctatatttctgtacagcttgttagctagaggtttgttgaagagtcagatgaacatctgcagacttacaccagaccagccgtcgctggaagctgtccagaggaagccccatcccatctggagagccataatatcggaatcgtgggctttgatgacacgtaatttttgggtggtatctaaatcccacaattccacaatgccgtcaagtttcccagcgtaaagaaacgacccatcgatcgctagggagaagacagaatctgcgttgtctgtcccaagggtcatgatttcctttataccaccaacattgtcctgggtatcctgagctttgctgaccagactccacagcttgattgtcccatcaccgcccccagagatgagtacgtcagaatcggcgtttgctccaattgtcgggcccttggccatgagcatgcagtagacatacccattgtgtgcaaagttacggaccgcaccgctatcaatttccaaaacagtctttggtttggggatgagactccatctgccatcggtcctgcgtggtgtagcagagccaccaactgctttagaatcgaagaaacgatgggcccttctgttggggtgtcgttgagagtcgggggacaccttggcatctgaatcgctcaactggatccactgaatggacgaattctgtgcccctagatataatgtatcgtgctggggactgtatgcggtacagaagatatctccggcgtcgtggatgctatagatctcgtacagcctcgttagacttttggggcaccacacattgattatcgggtcgccggcactcgagaagagtaaggaggcatcggagagcacggatagagagaggacgcttcgtttgtgagcttggatcgtgtgtacccgttgaaaggtggtcaaggaccaggccacaatttcgccatcttgggtaccagcgtagattcggtcgtcgcccggactcactgccagagccagaaccgtgctcccatgattcaaggtgtggacaagccttggcttgaggtcggaggtgaggctgtcctcgtgtgtcggactcaggacgggagaagtgggcgacgatactacgtcgaccggcggcattgcgcttgcgtggctgggcgaagcgactactttcaatacaaattgtcagtacatgccaagtggcgccggtttgtgtaggtgtgctgagtaggaagtacaggaattggccgaggagaagaagtgttgaggaagaagctggaaccaaccagcctggctgtgatagcaagctgaactgggtgtagctgtggctcctcaagattaggttctcagtccattggaggtcgggaagaagagaaagaggtggggtctaggaagaagaataagaagaatctcaaggtcaggaggaggctttcaggagctcagcattgcgcagtcgactcgaacaggcacgccccctgggaagagaaaaagcaacgtctccctctgccctctgactcaagcatcggtgtattgcgatatcgtcgacgaggatgcgatggcgacagcgcgcactgaccgactggtctcagtgtctagcgccctggcaggcaccatcgcatttccgtacaggctccttcccagcatttgaccagcaacaggctaaaacgtcataccgacatccgatgatgtaagcacgccatgactgccccttcccacctcattcaaagcgcccttgcagaagcgtccctgatccgctgccagagctggggttcaacatgtggcactgggtcctcgacagggagtaatgtccgatgggtgtcgtctgctgctagaccgactgatgggcctggtcttgtgactaactggcaacaggacgacgtctcttctgagcagccttcacgacacagcaacgggcagagtgccagcaaggctgggaaccgaggagaaggggcgggaggattgtctattcgtccagtgcaactaacttaccagatgtgtttggaatccgaccatatccatcctggtggctttggtcgttgctgtcgttgttcccggtcacggcgcgattgccatctcgttggtgttcaaggatcacactaccgggccagatcctaaaagccatgtctcaatcgtccggtcgtcgagctcggcgggggcaggataatgtattgaatgtcaaagttatagcacatgtcagacctggagtgcgaatggcgtcggacgacatcggcctatatatgttgagtgcggctcgtcggcgtgtcgaaacacgtatcccgctcccttgcaggcatattgccctcaccgcatcccaggttacacggtgcacatttccaaggcggccaaccggaagccatatccatgctccgaatctcaccgcgctatgcctgcatatgtgatcgacaacccttgtcttaggatgatgctaacaagataaggccgtgcgacgattgctgtcatgtctgcacgtcctcatagcagatacatctcctgtgtccgctaagtaattatcctaactgcctgtatgaatgaagccagctcattgctggcttccaccagtaatgtacctgaaaacaccaagatagggacgggccggatttcggtccatgaagttacggccccgattgccgcccaccgcccaattctcttggcgtcttccatcaggcagcttcggcacttgaatcgggaggcctaattcttacccacaaaaacacaacgacggctggtggatgttggggtaaagggcagcaggttggtagcaggcaggtgctaggcacataataaacctctgttccgtctattaagcgaatacactgagaagatcgagcccaatgaggcaaccgcgatgtgcgcaacttccttgtgagatggacacaagcgagcaaacacgcaactggagccgaatctgccaagaatcttatcgccaaggcttcctattcgctttcgaatcccatcttgggataactaaaacatttcaaacagcatcatacctggccttggtagtataatgacctcagtaagtgcacagggctcgcgttgttagatgagatcaaggcatcccctatcatttggttcggctgctctatgttcttttcttttcttttcctcaagttagcaaccagctaccgaagactcattatccagctcccagtggaatcgcgacttctaattaaaggcaattgctagtggcgctcgctcttgacaagttcaattcttgctctagagcagtcaccggatactcacaataaccaacaagtcattcgcctcatcagaagtacatccttcgcctttgcccaacgctcccatcctcgacaagaaaacgccaatgtgtgcttgctcatctctagccctctgggacaaatctcttgactctagccaacctttgccgagcaatcctcctagaagctatagacatgcggaatcttcttgtgctaggctccttgattggggccctgcaccgcgccatggcttattacacgattgtcacgtattcgcctgaatccccagagattgacgggaagatcatcaacgcaaattcaaggtcgttcatcatcggcgcaaaatcaccaagcacttactgtgacctcaacaacccatctgagtgccccaacagctcttctacgctcgtaaacaatgacatgacccttttggctgtccgtgcaaccccagacttgctcatttcgtggcatgaagacattatgctaatagtacaggtagtctgccgtgcctggaggtcaattcatctgggtcggccttgatggttcggtgtcttacgcatcgccccattctgccttccgacctcccggatcacagatgggtggtttttaccccgtgaagctcctatctgattgcgcgacttcaattacagttctcgtctggcaatcgcacgatggcgcctctgggctatgggcctgccccagatcacccaaggagcccctctttcgagaagccgtcttgaaagcttctgtcgcaaattttgtgaatgatgggtgccttgaagtggaagcgatccagatcatggaggctggagacgaatatggggcatgggcttatacttgagaaatctaccgcggcgattcttgttgcgaaacatgtccaagatgtgtggcgggcggacttcatcgaaaatgtcggtatatgtgcgcgttgcttcgttttaggtcaacggtcatgtgttccattctcttctatttcaatttactccccagaagtcactctgatagggcaagctagttgcttatgtcaattgatgttgttctcggaatcgcggcccgctcattaatatcaagcggctgtctaagtgtgacgatgtaaaataagagtatctttaacaaagcacccacagaagccgtaacaatgtacacatgttctgttattgaacagatatgcgtcgaggcagggtgcaagcataaatgcctgtatggggatgtaatgagggtgccagaactgtgacaaagcaataatgtcccacagtgtggtagcctcttaaatcccaagaaggtttcaatcctcatggatcgcaagaacattaccagaagcatcgatcctagctttggtcttcttcaaactctcattacgcgggtttggtgcctcaaaaatgacactcaattcctcaagcgtcttgcctgcagtctcaacgaaccatttccaaataacaaatatttcgaatgcgatccagcagcagtatacaatgtcttgcgtccaagttgttagaaatatgtggaggtgaacaagaggtggcgctgtttccaatgtgtactcacataacttccacttgattttcgctattccctcactgataccgtaagtattgatgactatcgcaatattcaagaagagatagttcagtcctgaaccctttgctcgagtacggttttctaggcactcgacggcatatctaccctcaggtgttattaaaagcaagccaaggagtcgttgggctaaacggggaagcggtctgctcacaaagtctggagtggtgtgaaaccccacgcaaagcaaatattaaaaagataaatcgacactatcactccgtaggacaaattaggatgcttctcgctttgggccgagaaggccgttagcaggatgtaaaagacaagggagccaatgaggccccaaatcatcatcgttcgtcggcccagcttgtcgagctgatatgagcccaccattgccgcaatcatggcgaagatgggatttattgcgttaataagaagctgcgtgttggtgttggtgattccggccgttttgatcatttcgggcttacagtgttagcggatcgaagcaagactccttctttttgtttcgtttgactcaccataaagtagctaactacgttgttcccactccattgcccaatgaaagatgtggcgaccatcattgtagtcctgtatcttgctgctcgggtgttgaagagttcgcggtagtcccaccaggggttctcgtctcggtactgcgcggcctgctctatgatttcgcggtactggaactgaaccattggagagttacggtcaccctgtccgtggtacttggccattacatccaatgcttcctcggcccggtcgtgggcgatcaaccaacgaggcgactcagggaagaagagaaccaagcacatggctacgctaggcatcccggcttggacgacagtagggattctccatgcccatgaagatgaaatatgcttattcgatccgtatgttgcccagccagccctgtgacaatagaggattagcgttctgtcaagttatccgagccgtgttatcaggcaattgtgatgttccttcttacaggatattaccaagccctgcatagtatcagtattagcaagatccgctttagatgctccggcagaggtggaacttacaccacaggttattgtacgttccagccatcacacctctgaatgcaggatgggcgagttcaacggcatacgcgggacctgcggctgacgcaattgatgcaccgaaccccaagaccacacgtccgcctatgaatgctgcgaggttctgggctgacgtttggatagccgtgccgaccaacacgatcgcacagccgataaacatgcaccagcgtcgcccaaggccatcggctataaggggacaggctggaaacgagattatctgtccgatctggtaagatatgaacacgagccctgtgcttgatccggccccagagaggccaaatgactgttgatatggtatcatggcgttaatggctcccatgagggagctgtctatgacaattgttagtagtgcttgcagtctaaagcgaagatgtaaccataccaaagccattcattgtagaaatcagatacgagattcccattatcccccacaaaggcatcatatgtctagaaaacatcctgggcttctgttcctcgatggcagcggcgagtgctgcgcttgcagtggtcacatgtataccttcggtcttgatcccactatcatcaatcgccaattcaggcagatcattcgagggtcgatgacccaggccatctttttgggcctccttcgacatagttgctatcgtgtgccaagtttagttgaaaagctgttgaatatctcgaagtaaaggtagtgaagggacgagggctccctaataagaaacaccatcggttcataatatcccggcaaatagcccggcatggcaaatgctgggccggccagatggcacgggataaacagatattggtgtccttgccatatttccccttgttccaacctataaccgccgaacgattttccaatgtcaccctaatacaaatgacccgcccccaaacattaagcgctcctctcaactcagtgagccattgtcaatactagaaggttgccgagagtctaaaaggattgtcacgtatacttccagaccgagatatagcgcacatcttctagactgcttcaggaatcgtgagcatccagaagagctacccatgtcagtcgacacatggggccgagcggggaacgcggggaagaagtcctctttcgaactttgccggtgcagctttcaattggcaattcttattgcatggccttgttttccactcctcctgtgggagagtcgccgatgtaggattcaattcggcaagcatgggtcccattttctcaactcccgcaccaatgagcaataccgccactctgtagcacaagaccaacgctgggatagatccacaggtcaatgacattcatgtcgtctcaccaagtcgaaaaccccactggtcttggtagtattcaacttacacattagccgggatgcaatcaccaatgaagcatagagtagtattcttgtcaggtgcttttttctctctcgtcgatacagacgcacctgtcaccccattagttggccaaagaaaaatgttccttccatctgactgtaaatatatttccagggcagagtggaagtaccaggtagtatcaggccaactcacatgttagaggtaaagagaagcttgtaaggtatgtccttaggaggcgcggatcaaacatttgtaaggtgtgtccaacgtacattcactcactcacctggaaacctaccaaacattccaacagagcactcaaagggactttattcagcaaattcccatatgtaacatggcctgataaaaacataagtttcaaaaatcaagatggctatctagagcacgggtaatggatatgagccatattatacaataaggctttaatttcgtggaaaccaatattgggatattccataccggcaagcaataccatcaatccccttctatcccgaggatctgtatggctttcttattatcccgaggccatttcatcgtcctacaaacgatacaagggagccagagacgcttgtaaacatgttttggatatggagctcggaacgagaaatcagattaaggtgtctgtttccggagatgggttgcccaacgcgttctatgtaaggtagttcatctgtggcaagccaggtcaaaacactaggtagccaaaagttgcacctcttctccggggctgtgctaaccatatacgccgttgaagcaatttcttgcacctcgaccgcttcgttatcaatgctgagtgaggaccgaaggaagccatccgtgactcgcgatatagcatggtagatccttctgctcaatccccacgtacttaagcttggcgtgcttgctcgtcggatgtatgaataaaccacctttcatatcgacaaatacagatccctctgtctcggctactttggtgaaatgttggggagggggacgagatccttcaaaaaaaattaacgaagcttacagtattgaatggcaggttcaggatttcaaccggtagaataggtagctcaaggtgagagctacggcctaaggtgtcaggtcaggttcaaaatacgttgacagttgcttgacgtttgttgacagctttctcactacgaactgtggtccagatgcagtgacacagaggaccgaattcgaaagtccaccctccatctacccttcaatctcaaccctcccagccagccagcaattcaacgtgagaacacttatagaattatcttccactaaaaatatcacttgcaatgccggaaacacgtctgtcaaaaagaacaagagatgccaatggccaaggatctacaaaaaattttgaagaatttgaaatatctgaagaatctgaagaatttgaagaaccaacggctaaacgacgacagctgcggattaactcgaagacacccagttcttctcgaaaacaccccaacgatggccaaaacggtgtgcctgggcgatctagtggcagcaagacccaagtcaaggatggcgatttttccatctgcgaccgtctggacttcagactgaaagcatatattgaccaagatggtaaggagcgattattcatgggcgtggtatcatgtggtagacatctccccaatctggtgtccccggtccaaggcttgaatcctggcataactatgggggtatgctccttgggaaatacaagtcctcttgatgcagctatctcaattgcaggagaccattccgagtacaaacatctaccacatatgccccatgttttttttatggtctgcccttttgcgaagcatcctgatggggaggagggcaccctttcttccagatatgacaggatattcctaagcagctctcagcaacgcatcaatctactacccgagatgtccagggatggagaagacagcgatagtgatatgtcaagccaccctgacatggagcgcctgatccgggaacgagaccatgcgattcgtgaacgagatcagtcgaatcaagaacgagaccaggcgatccaagaacgaaaccaggcgattcaggaacgaaacgcgtttaacaaggtcgtccaaaccgggaacccatacagtggccataaccctgttgatttagtcgggagatatgccatttcagagaaccacgcgttgctatgcaatggttttatgagaaaatgggaggtcgattcctcagaatgcagagataaattgggaaaagcaaccgacctaagtgcgcgccacgcaatcatcaaagcaagtctcgatgacatatatcagctctcgcaagaattcaatgctcaagcggaatggatgtcggcacggcacacttctcgacccctttgatgatatgatagcatcggatagttcatttttaggggctagctctaacatatgacaaggtccagatggtcccttgagactctgataaccttcatttctccaaagaaaaaaatacaacctcgctagacacaattttacaactttccatgatcctagatcatcaacatatcaatcgcttgagtgacctggtgtctctcgtcctccattttcctctttttcgtcatctccataaactccgcttgtatctgcacttgagctcgtcgcggggctcagttggccactcctatggagcatgcgacgattcttccagtaagactgtcgtacgcctgcggctgtccttgtggggaagtgagcctgtgagtatagagctgagattagcggtgttctctaatcgtgtcgggggaagcactcgtcgagtggtcttgcaaattcacctctatattcttccatgacagtccatctttcttcagttttatgaggagatttatttcctcacgcgtccagcgtcggtaatacgaggaaacctcggtgggagtctttggcgtgtcctgctgaagcatccgtgaataaaacttgtcttacagaatctaggtcggcccagacttacaggatgctccgatttgcccagagaggtcagttcagctagtacaacaaccagatttcgatctttcaagtcctcccacggcgtctcattcgggtgctctgggagcggcgtgcgcttgtttcggagagccctgacttgccagagcttaagaatcgtgaccttacgtcggtgtttcattccagtatccataactaatggaggtgaggttcaagttcaaacaaggtatttgaattgtcagaaagcgagtgggcagggcacagagagcgtgtgaggagacgataaagtcaggtggcgtgaaatatgaaatgatcaaatgctgagattgggggagagcttgaactggcaatggataagtgacgagatgcttatatacttattgtgcggatatcacaatggggcaaaggtgatgaacaagtgaattgggctctggcgttgggggaatttgaacacccaccaattcaccctctctttgacttctgcctaatcgcctactcctcattattactttctatatctaaccgtaagtttttccattgtctgtcttggccaaaaacacgattgctcggcggtggtgactaaagggacatgtatggaacaggagtaaggctctcttgatgaacatggatggagcccacacggtattcagtgcatgttattccctatgtttgtgtgtttgcggacctgcttctttttaaggacaagagcctgtttgccatgcatcgtcttgccagcggatgatcagcttgattactacggatgtgacctaactcattgaacactttcgggtttcaggcctctgattgtacaatgacctaaagcaatcacgaacccgatttctttatatccccttatttcaatcctattacactaacgacatgccgtctggcgaaaatacgcatatggcaccctgtacgaccaatgcatcaagcaagggacagctcaagcggcatcattttcaagcgtgttctttcttcgcttagctgatccacaaattatcccttctttattggtttttaacacacctcgagatacaatgtcttggtcttctggagtgcacatttatttatgtgtacttagtagctaccccattacttgcgtactcctgtccttagtgaatgtacttcacaacgttttgaacaccctgacctttttataactaatgaaggctattcggactataatttatccattgataagtaaatgcacccatttcaaccattgccctcctgcgttgacgacatgaatctccaggaatcggagctcatatagtattgctctagggtaggctaaaaattggacggtctccgccgtcggtgaatcaagctcagttggagaatctacgtgccttagagtctgtctgagatgcctagttctaatctaggcagtggcccaggtcagggagaattgccaggctgcatcgaggcaaaattgagtcgggtcaacttgaggattgctgacgcttgctccatcagatcgcgcacgaacaatgcatgtaagtgatggctggtgatccctgtctccccacacacaaacccctccatccgcttcttaattctgcctagccgtaataaagtgttggctggcaattaccaggtaaggctggctggagcgcaagtaactttccatcgagggtcgaccgctttcgataaaaaatgtggcggggcagctaataaccgtcatcgcaaccaggctgcatcgtccctccgcgtcttgtgtcgcccacctccagcctcattgcctcccgtcttcatcagtgactggctctgttgagatattttcctaggttctatccaattttgcatactcgccggtctgcacggaccgaattcttcctagaaaatggacgaccagttcggaggccgcaccgatgacgatctcttttacgacgacttcgagcccgtcgagagtgaacccgtagtcacccaagagactgtaaagcctcctgcaccaccgccagctgccccagcccaggagactcctgctccgcaatctgcgtctagctctgcccctccagcgacggtgaatccagcgccagccaagtcggcgccgagagggctcgcgtcctcccgctacgccgactctcctgagcccaaaccatccccttcctctgcgcccagagagcagcagccaaagccgcagcccgaacccgagaccaagcccgaacctcagcctgcgccccaggaagccgagaagcctcaagctcccaagcagacacaggaacctgagcaggctcaacaacagcagcccccccaacacgagccgtctcagccccaagaaccatcacagccaaagcaaaaacctcatcatcagaagcgtcagaagcccgcccccaacaatggaccgcctgccagcgcgcccaccgccccgagagacaagtcccaccgatcgtcggagaaagactcccaggcggcggcaccgaaggaagcccggctgcagtccggcgccaacccccggcagaagctcaccgaggccgagctgaccgccaagatggagcagatgaagatcgtctcggccgagaagacgcgcaagttcgagaaggccgagcaggacgagaagcagcacgcccaggcctacgcacggggtatggaggaggcccgcaagaggaaggtggaggcggaggagcgccggcgccggggcgaggagaaccagcggaagctgaacgacgagcgcgccaagaaccgtgaacgcaagctcaaggccatgggcatgaaggagggcggctgggacgagggcaaggaggccatggctgaggaggaatcacggagaggcttcaagggcgctaatggaggcgtgagggggacacgaagtggtggtctcggtggcagtcgatatgcgagggggggcgaggaaaatccagatgtagatcgattcctggaggaccgaggccgtggccggcggaggggaggaggaggaggaggtcggggacgcggtggtaatgggcgcggaggccggggcggccatgaagctgctggggagagagctgcggaagtcaaacagtcggtccccaccacggacgacttccctgccctcccttcggatggtgtcaagcaagacaactccaaatcagtccctggtccagctcttaccgcactgccaaagctgaccggcgggaaatgggatgatgaaatggcggatctcgatgccgccaaccagaaggcatgaaacgttgaggcccgctggctctcatgccaaagaagcaatgctcaaacgagtcggcattaaaagtgagatcctcctgagctaagcgttgtgttaggagtccaacagctatcgctcacgtaaggcggctgcagcggtattggatatatacattttaaaaacaggatagtttgcccttgatattttgcagtaatgatagagcagaatcatgatacctcgtaatttgacatggactttgaaaagaatgataaaacccaagagttgtgctttgtatagtgaacgcattgtatacgctctcaaaacgccaatgatttatgcatgacccatgcggcaaagaccagcttttgacacgttgtaatacaatattgaccctgcattatactaacaagagaggagcatactcaagaaccaatagactccatctttccgatgttgatcccgatatatataaccgaaccctagacgccaagcttgcatgcattaaagaacagtcctaatcatccccaagaatggactcccgaccgcttttcaccagcctccgcgatacgatctgccgccccttccgcccctgtagcctcctgaccctctaggtcccctcgggcctccgccaggcccatcgtcgtccagaggctgtcgagcgcgacccttcatctccctcgggaaagcatcgtaagtcttgcgcatctgcgcgtagcccaagtgcatctttccgtagaagtgatctgcgaggcggcgatcgttatcgaggcgactgaggtatgcgccacagacgtcgcagacctggagtttctggtggcccgagggcccagacgtatcggacagcgccttcagctcgcgctcgcgctccgccttggcctgtatcgcttgcctgacccggaagagctcgtcttgggcgcgggagacttcggacatggagccgaggacctcgacttccaggaagccattgctgattgacgaggatagttctgatatgttcttgagctgtatagttcaaaggagctctgcggttagctacaatggccttcaatatgatagacagagaagcaaagtatagaggggctaacgtaccagaacgcttgtctgacgaatctcatctggcgtcttctccaacctcctctgcgcagcatcgatccttcggttgcactcctcgatgtacttttgcaggtcgcgcatgtagtcgtactcaaatccgtatctctgcttctcccgatctggaagcgcctcgtattccaccttcaatccctcggcgtggaccttgggacagggcccaatgtcctgcttggtgtttgtgaacaggtcgtgcgggcacgtgccggccaggtacgaacggcagactttcgggtcgttaagcgaaagttgagctgatcgcgacgaggaggaggctcccattagctgctcaagcagcttcctttgctcggcggccatggttgcggttggtcgtggaggatggatggatgggaggttgttgtaggttgcgatcgcgactccggcaggtcgaagaaattcggcgccggaggttttcaatggatccagcgccagctccacatggctggtagctctctgccagtttctgacggtgcctgcagctccctgatggtggggccatattgccgccgtccaccgcttaactttaagaggcaagctccaattccccatgctgtagggcgcgctccgtccggattacggtacctaccacctaagggatagtgagtacaagctacgtatctccaagtgtctgtgagcgacaagccaccatctatcaggttgagatgggaaacgcccggtcgcgccattcttaatatcgtccaccgatttactccttcatcccattccattcattcattatgcgtttccctttgagcatttcctcgctcctggcatccagtctcctgctttctaccgcatcagcatcatcgggctaccacgagcagctcaacctgcgaccgctgcctctctcgaacctgcttgcgagcttcaacttccgatcgaacacgtcattggccgactttgaatcgcagaacttccgtctatttcctcgttccttgggccagatcctccaatatgccggcacgcgagagctacacctgcgcttcacgctaggacggtgggatgccgagaattggggagctcggccctgggacggcaccagggagggaggcacaggagtcgagctctgggcttggctggacgccgagacggacgaggaggcggatgcgaagtggttgactcttacaaacgccttgtcgggtctcttctgcgcaagcttgaacttcatcgacgagacccgtacgatccgtcctgtcgtgtctttccaggctgagggcgaccatcccaataccacgctcgccaatgccaagctcctgcatggagtcttaccgcacgaggtcgtatgcacggagaatctgacgcctttcttgaagcttctgccttgcaagggcaaggcgggcatcggcagcctcctagatgggcacaaactcttcgatgcctccttccagagcatggcgatcgacgtgcgaccggtttgccctccaggaggcgaatgtctcttggaagtggaacagacaattgacatggtgctggatatcagccgctccaaacgtccacggggtacgtatcgttgatcaatttggtataatatagcggatgaaggctaactctgaacagacaatctgattccaagaccaatccagggacacgaattagtctgcgatacgtccaagtcctatcactcggacagcgtctgcttcccggtggaccatcttcagagccaggaatggaccttggagcaggtgtttggcaagccaatcaagggagcatgccccttgacagagccaggagtcccccctgtctgtgtcgaagtcccccattcgagaagcatatttgcttctgaaggatctgccgagattaagagccaggacagcgcttctcgttgctatgacctggcctcagagggtgacttcaatctggtcctcacccagctagatgcatcaagcggcgacaaggagcttgtggagcctgagcagcccctcctctacgccgataggagtttcaccggatacggacaggaacacggcggcgtgcaggcgatcctcaccaacccaggtgacgaggaggtcgagttcgtctacatggagtctctaccatggttcatgcgagtatacctgcacactctgagcacccgcatctctgccgcctcgtctatccctacgacctcagccgaaacgtcggcagagatcatcaaagaaatatactacaggcccgctctcgaccgcgagcgtgggacccagcttgaactgctcctgcgcatccccccaaagtcgaccgttttcctcacttacgacttcgagaaatctattctccgttacaccgaataccccccggacgccaatcgagggttcgatgtcgccgccgccgtcatcacgacgctctcgcccaggaagatgaacatccggaccacgagtctgctcctctatcttcccacacccgatttcagcatgccatataatgtcatcatcttcacatctacagccatcgccctgtcgtttggcggactatacaacatcctagtaaggcagattgttggcgctgacgagggtttcgaatccccagtcaagtccaagctcaagcgatttctggcagtcattaccaggcggctggcaggatagatagatataaaaagtaacgagaataaaatttatttaattgatattgcactatgctgataattctctccatcctgaagcaacttggtagtcttttaggtctattcacaggaaaccaaccaacatttggtcttcagcaaaattaaaagatcgtctataagcataagagtgataaaattggaagttgtatccacacaaaacgaattataaaaaaaatctagcaactaaatgaaactccgaaaagacttagagcccaaacccaatcagacaagactccattccatgtagcgtgatgtgaccatccacgcactcttacgatcagagggctcaaacatgcccagttagttgtagcaggtgcaagaattgaatcaaggagaaaaaaataacaaaaaagaacgcctaccaaatgcgtttcgccaccatgtcgtaccggaaaacgccgttatactcagcatcgggcttcttcttctcgtctaccccgactcgcttcccgccgggccccttgccgcctttcagcccttccttctcgtcggcgtgtatccatcgctgccgctcttcgcccacttctacatatccataaccaccggccctgcgaccgttggcctcgtatacttctctttcggccttccccgcggcgattagggcctccttttgtttcatctgggcgtatcgattacgagagtactttagcaggaccatcccgaggagcagcttgatgacaagcaaaaccaaaaacataaggaagaaaaagacaaccattgtgagcgctgcaataacatcatcagaggtccaagagtaccaaggacgggagtttaggggtgacccgtatgggtatccgtacgtagcacggcccagagaatcacggatcagagtgtcaaaacggttgagggctgccatcatggctggtgatgacggcgcagcttgctcctccgttagggaggtttgcgtcgattgcggcgctggcataggcaagtgagttgataggaacatgtggtatgtctggaatgaagctcgaatgaataggcaagagagggggataaccgccaatcccagccgccgggtcaactgaggagtcgtgaatgcctagagggtaaacgtgttagtttaagtatcgaacagccgtaagctctgtgatactcacattcgtgtagtaatccttgcagagaatatcgaggattcggctgtaaaaggcaggtttgatattgttgaacttggtcacataggcatgctttatagaatcaaccaacatctcactgccaatcacgatcaggaatggtgacaagacttccccagacatcagccacgaaggcagcacggtgaaactatgtgggagaattgaaggatttcgaagaggaatggggccagaaaggtcatcatcggcctcaagcccggttccaggaactgataaaccaccgacttctacaacattgcgtaggccaataatgaagagcatgatccaaagctggaagcgctctactatgtccgcacaagtaagttgaaacagattgtccttttcacaccttttgaatacggtgctcttgatttcgacaaactgattagacagaagtagggtcaggagggcattcgagtacgaattgacggcgacattaagcgtgatgacctggtaatacagggcgacagaatgaaggcagttgtacaccagtgccagaatgaacattccgagtggcataagaactttggaacgaccagatgagtttcgagagagtgtttcgttgctgaacaaacactcgagaatatcttggcccaaagcagagagaaggcgatcgccgacctctaagatattgtagatgacatagagcttgattgcggattgggcacgaatgaaatggtacattcgacttgcatcaagcgtcatgagtgccattgagctgaagataatgacagccccttgtaagagatccgccttgtggaaagttgtcaaattcgaaggcatcgacttcgtcctcttatgacgaaaggagccagacttaggcccgggattatggttttgaatttgaatctgaactgctggtctggtacttccagttccgctcaggcgggaatcgccccgttgccgagctgggtaccgttctcgtggtgtaggaacagtgtcaaagtcgacggagaattcgctcgctgtgctacagcttcgggaacggcctccggcagactgtccgttttgcctcttgaactctcgtccgcggcggcgcagcctacccattcccacccatacaaagccaacaagccatttgacctccttccataaaacgtacgcccaccatttgaccaggactcccacagcaaggacgaatcgaataggtagaattgtgaatgtgtgcaaccacgcgtccaagcaggcaagggcgccgaaatttagggtccgctccaagtatggcggcaagagaaggacgtttttgagtctctcaagcttgacagcgctcgactcgtagggggtgtcattagaatgaggatgatgaatatagagagggctaggtcgctgtgcagcaatctcaagctgtaggtgggtgggtatcgacatcgggggcaagggtattttccccagcaagggcgacggtggccctgtggcagattgtggatctgggatcttgggtgtggtgatggtggcagggccagttcggatcgagggcagcgaggccaagtgccgtgtatcaatgttcagatttaagggaggaggacgcatagactgattgaaggagtaccgtctgggagatgtggctgccgcggagtgttcgttgggaaacctggtgcggttggctggtggcgttgatgccgtcctgggggctgggctgggctggccaaagtcaactctgtctcttacctgctgccacggtcttcggcccccgcgcccgtcgaactggccgtaatctgtcccagggtcgatcgcagatttcggcaacagctcatggtgatcagagggcactgatctcctgtcaaagtcgacgaaacgtcgttcgggggcaggtgcgattggcaaggagtcaggggacttggtcaattcctggaggtcggccgcagacaatcttcgaacctttagactaccgctccggcttcgcgacttggccgcagcgccgtctgtgtgtccgttcgccatggtacagtcctgcgagggcaatggtctggccagtggcgctgggtctgagggtagtggcgctttcaattgctcgtgcccaagtagtctgttcctttcttcttctattgaggatcggccgtcatcggaggatggggtggccagtgtcgaggctactgatgtcggagggctaacactcgtaaagctcccatcacttgtcgagatgcatggcggtggctcgagaccctctcgtcgtcttggcgttttggtggtcgcttctgtctccgggcgaagatagtcgtactcggctgtagcggccattacaggtgctcgcgagcattctgagctggcagtacttcctttccagccgcaggtggtgagacgagatggcgaggaagtatgttgcggtggaggatgacagatgggaactcgaggttagttcgatcattacataaaagcttgaaagacgaacccccccccagcgctatattagcactgaacagtgtgaactcccccacagttagttgcgaggtcatgggtcagtgcagcggctccacccgcctaatcctgtgattcccttctgagacatcagattacgtctgttggatattcctattcttagcacctccctggcttgggaatcgtgctgacttgaatggcctggtcctgagtatccatcagatctgtttgccatctccaggccactatgcaatttaccactatcagactaccatatgccatcatatgtagcacgaaaccttcaacccattccactatcatgatgacgctagagggtgtgaggactcgacccgggcaccaggtttgacaagcaccagcagccaatcggaacccagcgtctgcagccattctcagatgcataacgaatgacacttgggagatacagagtgtccctccgctttctttgtagtacacaccagccagtcaataaaccctcaccgaatctcaaaggtgacaaaggacacagtttcattgcgcatcggggtgctacaacatcaaaatcttagtttgagctaacacccccaagcaacagctcggtataaattactccggctagctggactgcactaaagaatggacccaacatgcgctcttccaccataaacccgcgttgccttatgggttgacaagaaactcgtcaaaccacgccacggcctgcttgaaggcctgttccttggcaaacctctccgctcgaacattggggttaccacgaacagcgaagccgtgctcgacgccctggaagagattgatctggtaaggcaggcctgtcttcctcaggatttcctcggacttgattcgcaacttctcggggaagatttcgtcagtctcggcagcggaaatggagaaggggccggtgatcgcagccaactcctcttcctcaacaaaggaagggtgcgcagagtagccaacgtcgattccgtgcttgtagttgcgcacgacatactatttagcctgtgtcagtgatgcaacaatgtataaccagggctaggtaataccttggcaccaaagcaatacccaacaccgccaattctcttgattcccaagctcttcaaggtttcaattccttggacgacaatggggtcaatagtggcgggcgtatgagggttattgccgtcactacccttggtgatccacgctgcgatatcccaaccagctggtctctccaccggcgcctggtcgcccttgaagatatcaggaatgagtgtggtgtagccttgagcggcaaaactgtcggccatcaattggctattgggataaatgccaaagatgtctgacagaatgataatagctgaatccttcttggcagggaaatccgcaccaggtgtagccaagtatgcgtcagtcttcccatcagcacatttgatgatttctccagcgggctcgccactttattctgtcagttgttttgcgtacccctggagccatgctttgcgaatccatcttggcattgcaatgaggggatgcggggtggtgcctacctgagaatccagccgcgagtgcaacattcaccaggggggtttgaggccatttttgttgtttcgatgtaaatcaaagcggttttggattgagagtctctcttgaaactgtgactataaaaaagctcgattcaaaactgttgaggagtgggaaaataaataaaagatgaagcggacgaggtggagatgaagacatccctgctttcatcctgctcttgcccctccaaacctcggcatagattcccgtggttggctaccaacagtattgcgaatgtcgagatgtgtaagcagtgcctaccccatttgtcaaatttctcattatggaaattgctttctcgagctagactgagggtcaagttgggtcctcgcttgacgtcgagtggcagatagacgagacggaaaaccggaaatagaagttgggaagccttattcccaaaaacaacttaacccaccaagtgggttgggtggaaacgtgtagaaagaagggctcgcgcatggatatattactacagtggaattacgatgatatctctgatcatcatgatgagatcccatgcgcccggcccaccttgctgcataccacctgctatgagacccttagtaaggctgtccaggcagcatgcctcagggtcataaaaaaggaaaccaggacaattacttctgtcgtgccgttttgggtttccgcttcttgaatacaatgggtgctggtcccgtctcgccgtcttctgtttttacttggggttctagtttcggctctgtcgtctcgtctggcattgtgaaaccctgtacctctgtgtcgggttcctttttaactgggtctgattcttccttcttgacatcctccttggattcgggggccccatcctcagccttgacattcaggtctgcgccgggattttgattttggtgtgtcaatatagagccgctcagaagagcatccagatctgcgtcctcatcttggttgccaacagtttttgaatctcgaccccacctcctcggcttcttaaacaaactctgcagggcttcctcctcctccttctcctcctcggtgacttctcgtttgcggacccctgttgccttggtatccttactatcctctccttcagcaggtttatcctcgatgactcgtgtgctcgtgacggtccattcgccagccatcgccatctcgggtctaaagtcgtcgggcatcgccacccctagctccgcgagctgctctctctgcttcttgagctcggcctcagtcgaaccggctggcgctggccctgcctgtgagctcccgcggggtccaggccgcgaagacgacgaggctccagatactacgccgtcaagccgggcaatctcccgccgcgccctctccttctcacgctcctccttttcatggtcgcgatgtaggtctcgtaggaagcgcttcaaggcgtactggtgcttggcggtagcttcatggttctggcgctcaaacttggtgtcgcggacgaaaacggagcaatgcttgcaccagtattttggtgtggatttccagtgttctgccatcctccagactcggcctttcgtgatgtgaggctaaaaatgaaagagctggcaaactgttcacgcgacgggcgtggatgtagaaagatcgatcttcaggcttgaaggattgaatgttggtctttgaaaaccgactgcgacaggcagaggcttatcgtcatttgtcttgtcgctccacttaaaaatgcagctccttaatgggtcaagtgggtgacataagagatgagatactaaaccggtactttaagcacccatatttgcagaggctctgtattgtatttactgcaacttgattctaaatttccttagaaaagactaaaaaggggctttaatattatttagaagctagtaaaaggattaatgtacttttctaggggttatgtatctttattgcagtatttaatagctacaaagaaggcataagaatttggtgtctcatctgttatatcacccggttgtgggtctagtatgtattaggtaataccaagttgagttaatgtattagtccaggcactcccgacttcaaaccttccaaaggattactaccttacgctccttctgaccattgatctacgcccagatcttccggtgaagctgccattcttcaacattatctatctgatttacattgtgtttttctctcagccctatctatagtcggactagttgaagggtgaggcggcgctacgtcgtgttgttctcgactcttacgacttacagctttggtttaaagatgtgtcagcacctactctagctaggtaccctaagtaatggattaccttgcaggaggcatgcagacaaagtcacaaactaggccagtcgcaatatgagttgtagcggcagaatatgacacaattccaacacctcttacaacccgattcgctcattaagcagactagacaccaaataggaggtacgtgtgttaagtagaattgcattcaacttgatctatctggaacaagtgtaacattatagctatgtggttcataggcatcaagcctgatgctttagtcgtgttctcttctcccattctgaaaaacaaaaaatccattcgttaactatctaaatgtacatgaaaatccaaaatacgcccacgatcaatgttgcgagagaatgtgatcccatcttgtttccccttgatgctgggggactggagggtgtaggattctcctcaatcggcttctgtgactgctgagaggaagaggaggaggtagcatgcagcttcggtgtcggtgtgggagagatgacaccggtgctggggccgggtgtctgtgaaggagaagatggagaagggctcaacgacggtagaggagctcgtgaaggttcagtgacaggatgtggcggggggactgccgtgggcacatgaactttggcattgcgagtcttggtgacgatggcgcccttggttggggcctggatctggccgtccgcgatctggctgacccgtggctggtccgcgttgtctggggcttcgcacgactcgacgtagatggtcacgggctcgcactgcttggccgaatttctatcatacaggttgtagaagtccccggaaagacattcatagaaggttcgtgttgggccgagtgcaagggtagaatcatcgcaaaccgcccagccctttgtagcgagtgcattgggctgtgcaggaccatcaaactgaaactggtggtttgaggcaattgagccaatacgattctgcgaatcaataagtccaccatccttcaaggacatgacaagtgcacctttgtcggtacactttcccttctgcgaacttgttagctagctgcatatagatactctctaaagacatcgatgagtcacatacctgtacttctgaacgcttttcagccctcttgctaataatgatttggaactttccgttataggacccagagcagccgtccgggattctctttgtgttgccgacatctttgggctcacttggaggggctgcgtggacggcagccgagagacacgcaagcaaaacagattcccacttcatgatgaccgtttgtggatccgagttggactagacgataaaatagctttcagagagcgtgtggatgagattttgtatttctcttagggttgaagaagtcggtctgtaatagaggcagtatggtgttggctgccagtgctgggacagatgccagtgtgattgttgcaatcaaggtgagtgccatggcatccaatatatagaaatctcgatatcaaggtctccccatcccagccctttgaagacgtttaatactggaccccaagcgtcattgactgttccccttgatacgaaacatctccagcaacccgcgagtcaacctcgcgtttccaataaagttcctgttgcgtagaggctgggcgcgtccaatgtctcagtgtgggacgaccagatctacctaagacctgcccctcaaaccttccggtggcagggttgagggcagcagatatgccagcagcaaggaagtaagctgggctcatggcggacaacggacgtataagatgtgattgtgacattgaaaactcatctaggaccataaaaagatcccatcgttgacggattcttcgcaacagagccttctactctccacggttaagaagagagccagccgagaaatattcgatgtagtgcccaagcctaaacccgttccccttaccagggaggcgcaggtatgccacacaaacatttcgctgaccatgcgagagatagaattactgcgaaatggacaagggggggttcctttccagcaactcggccagggaaaagcgtttccagacgtggctacccgtggaatgtgtctttgtctcaggtaccagcgggaattttcctaccagctttcagcatgccaaacggtcgcccagccatcaaattgatgcataaagccctgtgggggggttaaagttctgagacctctattgaactttcatgttcctgtcgacgttttctctaggatcttataggagtgtttccaggaatttggcgctcgtgagacagacgccaccatgtgagcagcgacagcctttgtcgagcatgaaattcctacattaatcaacgacacaaaccaaggggtaagtaagaaccctccataccatctcatttgtcagtaaggagcctgttgccagaattcaaggtgggtgagaataagattggttgagatggatgacaaagtaaattttaagtatattccttcctcgtcctattcagacaatgtggtaacagactacggtatcaagttctaaccttctatcaagagcaattaatctcttcgcgcttaaaaatagcaataattgttgtagccgtccacggcgatctccccattttgttgtttatatcatatctcttctcgtcaatcatatcttcatatgtacttcattcttacaccctctattgtgcgccagccagggagagtaggctctggtggttggcaaaaagactgggttgggccttgtacagaccctgcacggtcctcttcaccatttcacgagcttcgtcctcgagctgctcctcggggggactcaagaccttctcgaaaatagtaagaagttggggagtgaactgttgaactgtctggttggattggtcgtctgtgaataaaatgttagtcattgtcgtttgcacaaatcgagtagttcaaacttacaaagctggtagatattctggaaaatgggcacattctcctcgtagtcctcctccagaggcaagacgctgatgatggaaggaagagcctcggcaataaaaccattgtcggggtgcttgatcatcatgcggctaagagcgccagatacgttgtcggccattcgctgctccttgacagccaagagaggctcaagcttctcccaaattctggggtagagagggaaggtcttggcggtatcgttggagttgagaaccagcatgccaatggcatatgcagcatttgacttggcaagagggtcggtatcggtcagacggcgggcaagagcctcgccgagagactcggtgtaaggggtaacagcttcgccaatgtacttgacaatctctgcaatggtgccaacagcagtggaacgctgaatatcctcagttgagctggccaacttgagaacgggcttctcgaaaatcttccagatttcatggaaatcgggcccgagcgcagcagcaaggccgacgaccacatcgagggcggtgtcagtgacaagccagtcgtactcagaggatccagcatcaacctcaggctcctcatcctcgaaaccgaagtcttgctggcactggtgagatcgcgtgacaattgttccaacgacggagatgatctcctgcaatgcaccatccttagcaaccagaatagaaggaccacaagccttgagagtggcggcgacatttcggttgatgtcggtcaccacagccctagcacactctgttagtgaacaactcatacaaatggctgcgagggtacaaatagagtgaggaaatggcataaaatcaggagtagatgtaacgtgttctcagcaatcgcattttgcgtctgagtgagctgggtttaacgtatgatgctcatcatataatagcctgaaatgaaaagttgaaaatgggttatgtacgtacctttcgtgctcgtcaggccatgccttcagagtagggatcaagatggtctgtgcaatagagatgatggaaggagggggcgtttgcttggggggcataccaggctcccatttggagccagagccatcctcccaaacctggaagacacgggcatagatgcgccagagagtggaaatggcagtcttgcggcagccttcgtacgagtggccagtaaaggggaggaccttctcgatagtcttttcaacaacagtctccaggtcgttggtaccacacgagtgagaaatgatgtcgccaagaacatcgagagcaatctcctgctcaagagccacggcggtgacagcaccgagaccctcaagatcttcgagatcatcccagtcatcatcaccctcagccatctcatcttcctgttcatcagaggaggccttcaccttgatctgcttgccgccgaccacgatggaaccatcaaccagtccgctggtatccagaccagagagatcgatctcttcctcctcaagctcaagagagttgaacagaccctcaagagcacccttgaggaagtggttgaagtcctccttgtagaccttggcaagattggaccaaagaatgaagctagtctccttgagacgagggttgtcaatgcccagagcctcttcgcttgcttccatcagcttcatgacatatggctggaaggcttcgggaccaacggccaaagcgatgcggcccatgctgtcgcaggtggagcttcgcagctccagagcttcatcattctccttggcaacaacgaactttccaagagcttccatgacatcgttgaagtaaggaaggaagtccttctccatcgcagcagcaatggcaccaagagccgaggcggcagaagacttgacgccaaagtctgagtggtccaggagcctgaccatgggtcccaccagattgggtccgtactgagccatgatcttggtgtcaacaccatcaccgagtgtgtcaagggcagtgcaggcagagcggataatgttgatgttcatcttgtcggaaggaccttcggaagcggcctgcaaattcttcaggacagcattgataagttcctcgtggtgggataccatctcatccaccatctcttcggagaggtgaatcagaccaatcagagaagcatatctgacctgagtctcggcgtcgctcaaaaggctgacaatgagagggaggaggggcttcagctgagtggagatgaagtcaggcgcaccctcggcagcgttaccaagagcaagcatggcggccatacggaattgaggcttctggtgagcagcgaaaatagggaactgttctagaagggggacaatgacttgacgggggggaagctcgttggcaagagtgtcgacaagtctgatggcgctgcgggcaggagtaagctcctcatcatcatcagtctcaatctcgccaatgatgtgcatagccttgatcatgagctgggagcccatatccttcatggcctgaatcttcatacggcggtagccaaccgacatgacgaggaagttgatggcctgagtacgcgcctcctcatcaacctcggtgttggcggcaatctccagaaccaaatcgagaagatccttgaggtgctgacccaacaggttggggtcgtgagcaacgaaggtctcgaatacctcgaagacggtgttataaccttcgctgtcctcatcctgaatggtggccttgaggatgttgaccagaccaggcaagaagccctggagaatctgtgttgcctgagggtcctcctctggctcaacgagaggggcgatgaccccaatcgcgcgaacaatgttgacacgaacatccttgctctcggggtcctccagacgggagccgcacagcttaagcagatcgtggatgtggtcgaggaagtgcattgggttgttctcaagcatggcgtatagcaggtatgaaccggcctcacggataccaacgttgtcgttgttgctcagagtaagaagctgcttcaaaaactcctcgccctccttgttcttgatgtccactccaacaataccagcaatcaggcggcacgcagagtggcgcaggttgtttgcggtctccttcagaagtccatcgaggaggtgtgtgcgagcaagctggcgctggtcctgagcagttttctcaccccaatacttggggacgaggcggagggcctgcacgtaagcgagctgacggacatcctgagcttcgttggtgagagcaatctcgatcaaaaggagaagcgactcgggcttggagtagaagtccttctggagttcggcagtggcggccttgacctgttcggtgtttgctgcgaagcctcaaagttagtggctaacccagacaatctagtcacggcggtggtgacgctttgatgaagataattagtacttacgcacttgactgcccttgagcagctggacgagcttggccttgtccatcctgtcgagattgcacggtgaaaagggctcgcagataggagtctgtgcaaggaggacaggaggattggggggacaaagcgaggccttttaaaaaaaaattggcggcgcggggcacagagcaaccaaacgcgtggtgggcgaaaaaaaaaatgtttttctgcccaaacagacagcctcaggtaaaatggtgccccgccccgccccgctccttccatgacagcgagttcaatttggctgattagcagcgcctagcaaatgcctggacatgaactgccaaaagcagcatcgatccgcgaatccgcttacaagccaacccatcgagctgatgaatgaggatgtgtaggaggagttcattcatggaagtatgccatgagttttctcttgggattcctcgacatggaactggcaatacgtggcctgcgctgggcagatgctaaggtgcagagaatgggctctgcagcctggaagaggtaaacaggcagtgctatggtgtctacgccataggagaacgttcacttccagttggtgttagtaggaaactaagccagttcttgggctctggggcccattgaccaagactagataagtcaagatagccctcagttttattcctcaacgccataatcacagttcccacgcaaactgaaatcatgcaaaacggacctgtcttccaggtcgccattgcaccaatgttggacataccaggcgacccccaaagataacatccactttacatatgtatgccttgcaatcccagagacaacgaacctttgcccagccgaaatagtggggcttcggacggagagaagcattagtgccaatgctccccatcatctttgctctgtcctgtgtcttggtggcgaacaccgttgatggagttcttctcgtgattgatgtgatgcgaatactgcccagtcgctcattcgtcgtaaaaacataatggcttgtgcatcaataattcaatccgaggtgggcttctggggaagacacaaatgcgagcccttcttgagcctgtcgcaatccaagtccttgttggcccctacaagatcatcaacagtgatgcctcggctgtgtgcaatgtcccagcaggtatccccagaggcgatagtgtagtccagttcgccttcttggcaaattactttcgggggggccgaccagcccgacttcgcggcggagtgcaaataccagaagaggaagaccaaaaacaagccgaccaaaatgaaaaagttgagcaaaggcatcatttccgcacgccatgatggtcggaattgctgttcggatccgaggaacggttgagcgtcatcatcgtcttcagagacacgagcttctccgacacgcgtcaatcgaccgtaacggttgccgggagcactctcccagtagcttccgtccgcatccttgaatgtgtaaacttctgtgtcagcatcgtagccgactcgcgacataccttccggtagtcgctcctcgtccgtgtcatattgcgagaatcgtgacattgtatacaggtctcgaggtcagatcgatggaaaattacgaaagcaatcgtagcaaaatgatgtgtccgtttggtttagatgagtgagtgatggtggtttcgatgagtacgcaggagagagatgaaggaagggaggtctcgtgtcagctgttagatataccgacgtaaggcgtctcatgatgattatataatcaatttcctcccctataaacgcgtcacacgagtgtggctgggttactggggcctgtgcctcaaatattgcataccttaggtacatacataggtagtttcagatgcccaacggataaatgcctaagtttttatgccaatacaaggatgagagtagctcaaagctcgcggcgtagggaggcatcggttatgatacccggctcctggaagttggttggattccacgagagccaaccccggtgttctgtttaaatcaattgtatttcgtataggacgaataatggtatcaacatcaaacgggcatatttctttagcaattccgttctggcaagcttctttttcagcttgacaaggtcgggcccaggcagccagccatcgagattgaagcttgagcatggagtgtatgctcgctaataaatccgacagtatttggggctggaatacgaaggccagccacctgatggccactattcgacgaaggcttcggatccggtgcacggtgccatttctcatgtttacccactctcaatgttgctggacattcgttatccaaccactgctgccccagagagcgccgtgtccagcgaccggacttcagttgaagcacttcctacagacagtgagtggcaagccaggcctcccatcccacttggagctcggatatggggacggaaagagataatcaaatgttttgttctccacgtcatttagcgagtgtacggtagacaaaaattgtctccaacacatgtctagctgtggtgacattgggttccataacggtatccccgttcggcgatggaccgcttggaccatcgcatcccacgagcctaccacaccaacatagtcgacatccacttggcgacgaagctacgggcatcttgaaagaactaaaattaaaattaaaaaaataattgaataaaaaaagtaaaaactaaaggaatttttttgcgccattgcagatgttctccctgtatgagctcttctcgtttcagatgcggttgtgtagaagacttcagaggcatggtcaactcgtggaaccacttgtttacaacttaaggagccgtctccaacgccccgcccccattctagtcttacgttcctaccacatacctagatttatataaataaatatatctccaatggtggcaattcgacccttgccatatcgcccgttagtggacaaaggccgagaaaatgaaacacattgactccgatcgcaaaagggcacatcgggtctatgtttatatgatactgcaagccaaccaccatcccaccaaatgatatataacaatgaaccttcccaaagaaacagtacttcggccacgcactacagcatacagcgtcaatcgtcttccttttttattcatttcttaattcaggcgggctcctgtaacatctttcccgtcaatctctttcccttgcctctgtgctccatacccttcatcccgtttcatcttccagctacccacagtcattctcaacatgtttcccaggtatgaacatacgtttcagcagtgtatatttcaagataggaagctaaacaattcaaggaaactcttttccaagtactacggttatacatccgccaccaaaaagacagaagagcagaaagccagaccccaacctatccgaacaacctcaagctacaactacatgcctctcttggaccccgaggactacatggagccatccactcctcgttacaccgccgtcagctgctgagcagctacaacaatacttactctcacaagtacgctggctcggcttgcacgatgttacgaaattagccggcgctctcattgccccacaattgttatgaaaggatcaaaatcaaattcagacttcgaataatgaggaagatgccctgtgttatgcagattacatattaaaatgaaataaaaattcgaaaagactatattatcaattgaaccttaagaattcaatcaagagatgatttggctcaaggtgttgtccatcatatttccacatgttcatggaccgtcggcccgtcttgaaacaccactcccgtcggctcgcggacaccaatcgatgccaccataatcgccctattcgatgtatgcttccccagaaaccagatcgccgcagcagtagcgcatgacagtgctgccacctttcatccaagaatcacgcacactcgtgaagcagcctgcttaaacagcttttaaggtgaaagaaaggttcttaaccaatccttaagttttactacggccagaaaacttccaaaataggtggttctgacgtcagaattcttctatctacagggctcatttctcgtcgtatcgtttaccttgcacctgggtctagatacagcttcatgctttgaggctcaaaattcgagtttcagctgatgctgcgcggatccggaaccgaggtatgtttgatgttatcgacatattaatgcggggcacagtggtgtcccggttcaccaaccccttataaataccttaactatacctggtcattcagccgtatcagattacgatggctctcaattaaatagatagttccttctcgagcttatttcacgtgaggacgagcttgtgtaaatcgatatggccacaaaaccaaaggtcccaataccattaggagaggtagccaaagctcacaagctcagcaacagtgtctatgaagtagacctagtgccgtcgtactgtgtcgggacaggtaataaacccatctcctaaaattgccaatgttgcatcacaactgacattcaggatagtgcccaatggaggcttcgtggcgacccttttctcggttgttgccagccaacacctggcatctcggaatcaaccacatacgctggcagctcattggtcattcctcaaccgaacagcggccgggaaagcctatattcgagtgatcgagtcaaagcttgggcgtgcatcatcggtcctccatctcagccttcatcaggatggtctgactcctcaagagcctttcatcgcacctgagtcccagcccaaggtcgttgcatacatcaccaacaccaaccttgcagacgagtccggtgtaacgctaccgacaggatggtcactcgaccacccgccgcccaaggtagatttggagaagctggtttccggcacagaccccaactgggagcgtttgatccacccgttgacgaaggcggtgcccatgcttaacaacttggaatactaccaccagcgttctggtcatgtcctccctacaacgcatgactactggatccgattgccatgcgatgagaattttacactggcatcactgggatatgttgcggacgtgggaccaccgcttttgattgaatcatttcgcccagcttcggtagatgcgcctatacctcccggcggatttgcttataagaaagcgttttggtatcctacactcacgatgaccttggacgtgcggaggacgatgccacccgagggactgccatggctcagattgcgggtagcggcaaaggaggtcttgaatggcagatatgatgctgaagtgcttatatttgatgaagctgggaggctattggcactcagcaatcatgtggccatggccttggatatatccaggaattatgccgaaaggcgacccaaagagaagatatagattcgaatagagaggtagatacagatagcggcggattttcggggtcttcgaatgacccggatgtagtatcagagtagaatctgcaagcattggtcaaatctaggccagtgcttcgagttccactgtacctaattcaaatgaaaggtggagggggaggttgggcgagagaagatggggaaagatgcccgtcgctagtcacgattttacagaggcgaccggattctctgagcactccagttttccccctatcaccaccagatctcttaataaaatacaggccaatacatgctcaaatttcgaaatttggctcgatgaaatcgctttcttctaatcaccaaacgtcctcaatccacatggtgatacacaccacctgtaattacctaccaatcccgggcgcgttaccgtgaccagggcatgggtttaaactggggagcagctcccaggatgcaggatgaagcagcgctgacaaacaagctcccgccacatggtagctcagctccgatcccctggactggacggcatgtgggtggtcagggccgtttcccccccagccttgtccgatgtggtttgccaaccataaagtcgccttgtgtcgccttgtctccaattcccattggaggtcaagataggcattcgtggccagtaatgcgggtacaatctctacctagttaacagtctgggggatcaatcgatgtgacagcctccatgctaatcataggatgggacattcgtttcctcgctgcgtccttcccaccattcgatccgatcctcagctaggaaaacaggtctcgagccctcaccgttcaccatggcggacgacagtcaaacagaaatcgttgtagcagcagcagctctagtagtctctgttatcgcttttgccgctacattgatgcaatgtctccaacagtaccttggctctgctcgaggctactcacactgcaatcccaaggtcataggagattgggcccaaacgaaatcccgccggttctcgctcaaagagctccgcttcgaagtgcaattcgacgcacccgttatatttgtttgtgcccccaacaacaagaagggcccggtgccggaggcagacgtctacaagcttgacgggacggaggaaagtctgagcgacacatggaccaccttgaatatgagccagagaaaggactacgaagacagaaaccgcaaggagcgtattcatacatctgataacgagcgggcatcatggacaatactgctatcggccgtccaatgcatggagaaggagtcccgagagtggcaggaggaagagttcgactaccaaggatccccgacgccgccccgagcctccctcccggaactagggctaccccccacgcctccgaccctcgagcagacccatacactggtggttgcattacaaaagaagcgaaagagctgggataccatgcctgccaatattacaaagccctacgcaacgactaccatgtgccatctgatcgaaataactgctgcccttggggtctattggaaggtctttgaccgaatcagtgatcgctatcgtgctgaggggaacggtttcatggttctgggagatcgagtcaatgatctaggcctcctgttttccttccaggtcaacggtatgtcacgatttactcggaaccgtgtcatacctgttgatgaggtcaaggaactctgctttgggtgggttccaaccatctatcgctctacacaagacaagagaagactcgagattccacttgatgtgctcgatctgagctcactccaactggctagccgggttgagatctcagaaacccttactatgatagggtgcaataacaacgtcaccaaatacttcaatgcgaaccgacgattttcgcatcttttcagttgtaagaagaaacggatccccaccgccaaatatgtgcactaacgtattgcttttctcagtatcctttgaaattttggccatgttagcccagacgtttcacatcgaagacaccctctttacctttctgccaaacccgacgccggatcgttgggacagcaaggctgtatctcttcccaagttactcgaggcctatgagctcaacttcaaagaggagcttacaaatagggtccccaggaatcatacaattgtaaacaggctaaagcaccacatggaaaacattattcgccagtatcgcaaggatggaactgtggcagagaccctcctacgttttagagcgctacatgcggcattggacgacactgatgagatccttactggcagaaaagcagcagcaagaaaggaacctgagcagggaagcaacccacgtgccaatttggatcctcggccgctttctccagccaaaaccctagaacgaattggaaccttgtttataggtacaacgaagaagagtgacatctccgcgaagcggactgggctcaagaagcccgtcaaacgcgaccctccaggactaaataaggaaacggaggaacagcagcgaaggagagagattgtacaggatgtccttcggtctcatattcaggaggttcttcgtctactcaacgaaccggatgaacgcaaggaccagcagactctccgtgtgccagaacaaattaggggccgatcaagagatccttccccatccgtgtcatcactgttggatgatgtcccaacgttcgagaatatggacggagccagcccggatgacagacagcacatcatgatggacgtgtacttcaagcgtgtacggcggctggtagtgccgcatgccacccagtcaacggacaatcgccgggccgggcgaatcaactcaccctccgagcgccgagcgagcatcgattctcagtccagcgccatacgctctaccattgataattctccgacggcaatagtatctgtaccgcctcagatcaacgaagaggcggccgagggagacgatgggcatcctactacactcggccgctcaaccaataattcggaagctgttcgcattaatggggtagcagctgagaggccgagtgccacggctatttcgaccccgttacccagcttggcgggagaggctgtgtctcatgatgatgtgtggtgcacgcttgtgtttcgtatgatctgctggttaatgttgcatgacttcaataagttggacaaacaggtggttaaaagtgagctgcttggcagcagaatgccggtttacatttcataatccactgcgggaggcattctattttctggacatgataacgacgaatgatttacgacagacattactctagaatgggcatgcgagtatagataataattcacaaatgttgggagtatttgatatttgtccaaagtgcatgctgggaagctttggtcaaccaactgccaagattctgaccgaatatcatgacaaccacacaatgacttaagttgtaaataccaacagtcgccctttgttaaaacaccacataccaaacgcattgtgctttttttgccgtatatttatcttctatggcatggtgatttcatacaactctatgcttctctagggtagtggggtgatctggtgtaacacccaatcagtttctggcctcatatctggcgatgggtactcggcaaggcagttcgcatccatcggggagacatatacacaaagccctatggcttccgacacagtctgatctttaggcttagtgattttcaccagagaaatcatacaatcggaacggccgtcgccactgattcaaggcgtgcggttcacgtgatggctatggtgtgagacaatgaggcggttaccactttgggcaaggtggggaatcggctatgggcgaggaattcgctggaaaagccctctagccttgatctagccgccgggaccggcaccgagcccaccaacctcagggtccagggccgagtgtacccacttcgaagcaagtatcgacgacacaattggtacctggctttacctcatacagggctttgttgtaagcgccgtgggctccttacattagcccgaaaggggctgacaatcaccaatacttgcttgtttgaggagaagaacgtgcaggaatagcattgccgtagggtatttgcggcatcctgcccatgagaatccgagatgtgagttgaacaaggagtggaatgatctcgaggtcatatgttgtattttgtgcagcctttttaaagctaggcactgggctgaacggtaaccaaaacggcaggcatggggacaaaggtcaaaatcgtaaatcacctcagctgataattattatacctcaaaaccaacggcgcagttacgacgcgcccgttgcgcccgcccgttatatgcactgtaacttcccttcaataggtgcgcgtgcgaaaagagtggcagccaacagcctggtgaagtcttttctcttccccgcgtgagaggagttgccggatgaagccctttgccgacaccgggcgctcttgagtttcccgtcgtctaccccggaaaatctactatgccattctctggacagacctattttttagaaagagcctcggccgttcacttgaagaatggaatttgctccaatgacgtagcgtgaattctggctgtcgcgaccagcccgagtatatccattagtcatcttgccaaaatcgcatctagtagagcggagccggggtctgcatcgtgattcggtggtggattagcatcctctcccacgatcccctcgttttaatctcaaaggccttgtttatcccggtggctgatgccaaggccagcgcatgctccctgggccaacttggaggcaagcaagggatgataatggcaagacagctgggcggggaccatccaatagaggcagaaaaaggaacaaggaaaagaaaagcacgaccgctcccttcaagcagggcaatgccgatcggggcagtgacaggcataagccagttgccgaagccccaggtcgagggaagaaaattccatgggaaaagcatgttggtcggtcggggtcgccagaaggagaatctgggacaggtgctgggagaggagaaggaagggccagcgcagccgacagttgagcacagaccaccacagcgccttccacttgtacttggctggacatttcgcccgctggtgacttgctgtctttgttggtccttgtcctttctctcggccttgggctccgctccacatacatccatacccatcactccaccactccacccacgtccattcccggttctactgcctcagacctgagaatccgttcccttccaacgctaccaaccaccgcagcccacaatcaaccccctcctcgacccagaggcggcttgatacgcggtgatagcatcacattctcgtgcagtcctcgacaaataccttcccttttctttatgattgtttccttctcttccggattctgggcgcgttttggttctcaccgtggtcccttttttcgtatcgggcccggcaatcctacgcatcgcccgtgagcacgctgccgtccctggcatccgccgaaacgagatacatagtaaaccacaagccgtcgaggccgtttgtatccccttcggaccgttatctggataacggcattttggcctaacatccgcggtaccgcctggtccacgaatctcatctccaagccagacacttgacaggactccctccctctttgtcctcgaccttccttgtccttccctccgaccagcagaatcactcgacataatgacacccgttcctggaagccctgctggagagactcggctatcgaagacgccatcacagactgttgccgtgaacgtagccgagaccggccaagagagtgcgagacgatttcaactcgagatgagtgaatgtgtggagaccaagactgtaacaacaacgactcgcctcacacgcaagtttccacatgtatttgtccgaaatcctacacctctcgaatgtctcgattccaaagagtaccctctggccctgaagcctgcgcctcctgagatcgccgacttctcgtataatatgcccttcgaggaggatattgccgaatccatagacacagatgtgatcagtatcgtgagttaactctttttttactacttttgtctggtggtttttctacaagacggaggttgctaatcacgcatcaccagccctcgcaacagtcgtcgaaacaagtatctgaagactccttcaccagtaacgccaccaagccagagccattccgtcatggcactccgacctcaaatcgagtcctacgcccgtcctcagtatcgccttcggaagcataccctcgccgctctagacaaactcgctcgcagggagcaacctccgagccctctggcgagcgccgacaagcacgaaacgcgcaccttaaggcggtgtcagataaacttcgtcggtcgatagcccacgggagcagcaatacaggagccagcagctcctctgctcaacacccatccttgagacagacccgagggtcttcgagctttctcgcaaccccagactcatctgagatagtagagaccagcagtgtggagcatccaacttcttctcgtacccggaatctgcacctcagtcgcaccagaaactccccagagcctctgcaatctgatgttgccagcccgatcccgagcgagtcgaacctgacttttagcagcaatgtggcgacaccgccaatcactgatgccgacgcagagcctttaaccgacagtgaggacatgctacggcattccacccgccatcttcgacattcgaggccgtctgttgacgtagtagccgctcaagatgctagtcttcctagtcccagattatctcctactttggctgccgctcagctgcactcagctgaacaagagatggatgatggcacacagcccagcagcttccagacaactaccagtgatggaagtctttggatggatgagtcccaaattaaggaggaggatgagccctccatggaattggtacccgccaagagtcgggccctcaccaccaggatgaagcagactgaaagctctcctgtcgttgtcgatcctcagatgctactggaagcgttcgattcgatgaagcccgagatgaagacttttatgatgtatcagttccttcgacgctgcgcccgacccactctccgtgttgttgccaacgccgttaacccagccctgaagtgcgacttcttctttcacttgcctctcgaactcagctatcatattctctcttatctaggtcatcaggatctctgccgcgcagcacaagtatctagaaactggcgcaacatcgttgatcgcaatgagaccgggtggaaggagctcttcgatcgggatggctaccaactccctgttggcgaactggcgaaggcaatcacacaaggatggggttggcaagatcctgtgggggccaccggattcgagaaagatctgagtatgcagagtcgcctcacctcgtctgaatatgaactcaccaaatcggtgaggcaagaagcaccgaagtcaaggaccgcctcgaagcggaagcgtggcctcaacacatactcggcctctgagcgctcaaagcggcgggctagtgcgcaggatgccacttcaatgcgtgatgataagagcgaagtcaagcagcaccgaagtgctgggccgttatctgcagccaattccgccgctgcagcagtgcctgatccccatctcggtctttcaagcctacggcagcttcatctcttcaaatcattgtatcgacgccatcacatgattcgacgaagctggaccagcggtgaggtgaggccggcacatgtcgcctttgccgcacatccccgtcatgtcatcacctgccttcagttcgacgaggacaagattatcacaggtagtgatgatacctttattcatgtttatgacacgaagactgggaagctgagaaacaggcttgtgggacatgagggtggagtctgggcattgcagtatgagggcaacattttggtgtccggctctacagacaggtctgtccgagtctgggatattgaacgagggatttgccaacaggtcttttacggacacactagcactgtgcgctgcctgcagattctcatgccaacgcaaaccggcaaggatgcgtcaggaaaggctatcatgcagcccgagaagcctctgatcatcaccggctctcgagacagtcagctcagggtctggcgtctgccagaagtcggatctaagcggtactatcagacaagcctcacaggctcagagtctgactgcccgtacttcatccgtgctctcatcggccattcgcactccgttcgcgccatctcagcccacggcgatacgctcgtgagcggttcttacgacagtgttgtgcgagtgtggcgtatcagcactggcgaatgcgttcataccctccacggacattctcaaaaggtgtattcggttgtgttggaccatgaacgtaatcgctgtatttcaggatcaatggattcgttggtcaagatttgggatcttactactggggcatgcctctatactctggagggtcacacactcctcgtcgggctgttggatcttcgtgacgaacgccttgtgtcggccgctgctgactccaccctgagaatctgggatccagaaactgggcgctgcaagaacacccttatggctcatacgggggccattacctgcttccagcacgacggctccaaggtcatcagcggcagcgagaagacggttaagatgtgggacgtcaagactggagagtgtattcaagacttgctcacggaccttagtggggtctggcaagtcaaatttgatgggcgccgatgtgtcgcggccgtgcagcgggatcagttgacctatgtcgaggtaagtgtttcccccattatgtgttctcctgatgaatttcaagtatctaattgtctttctagattctcgactttggtgctgtccgtgatggccaaccaccggaggaactggggcgacgtgtcctccttaacgaggatgaagttcaggctatcatggaggaggaagcctgagttaatgaccgtgcccctctcccttgtcgcccctgtcattcgctttattttccgtttcttttcatattcgtccacaaccacctcaacagcatgggattaatgttatggactgttactgcaggatgctaatcagtcgagcatctgtaaaaaggttacaagcatgggatacccggtacttatcaaatatttgggcgttttttagtcatcatcattcagagttaagcctttcgaccggctcgaaatccaggaatccagtatggcgttggagcatggtattattgtgagaaaatggagggaaacattattggtctgttcacatttgacattggtttaacccaggcccaagtgccttgggggaaaaaactgctatttgtttttctaagcttaacggttcgaggatgctacagaatcatgtttattaccaccacatagttagcgttgtttgttacttgggtccgaatataattgtgtgactataatcacggtgtattcagtctcatccgggagagtgatgctgttttgtgtgtgaggcagtcatgtgccatccgtgaaggttgattagggtttggatcgagaactgatatcctatatatttttatatactatgtacggtctggtgaaaaggtatccgaactggtgcaataggtagcacagttgggcatcacccactaggtcgtattggtgggcccttcggggggcaaaagatcttggttcgagtccagggttcggagttccattcttttttcaactaaatttctggttaataactaggttggctatataacgacagctcgtcgcagcatcaattaccccagtcagtatttctcacgcgcaatcattttggtcttctttggtcaattaggttcgggattttgatcatcagttgcatatgttacatacaataatacgcacagtatatatatatagcgtttactttatttccccgacccagatatacaggactggttacagccaaaggctgcaacttgggaggaaatgctctgaggagcaggaactgatttagccgtctcattttatattgagtccagaatggctgcctaatgcctacttaagtagttagttgtctcccttttttattttcttcttctattctttggctagccttatctattgggaaggcagcgtgtcagttttggtacagcagactcgcttgcagtgtagataggtttatggctacctacgcagagatcgctcgtcttgatggcagataggcttgctacctagctacatacatagcgatcgcttgtcttaatggtagatagctagcccgaaataatcccagcccacaaacacggcttattcagcttcttttttacagatctcgaagcatatttgtggcacagacgagcctctcgttgttcgtatccagttcgtccttatatctgcatgagctgaatgaatgtttacggcagctctctgtcgccaaattcacttctatgatttcacatctacagtcagctagtcggcatcaaatgcccttgattaggagcccgggccgcactctacaattaaccgtctttgccaacattattaggttgggagcgagggtttcggcttttccacaccatagagatacgcaaatcaccattcatatctgcaaggctataatttctcccatctaataaaataaaggcgtgcaaggctggggcgcaaggccagtaagccgagagatggtcatacattactagatcggtcgttggttatcacattggccagagcccactggaataacctgaatagcatcgaccgctaagatctacgaccatatctgcgagacagcatatcccatctacttcttgtctgacaggcctttcgctgctttttggacttctagccatctggttttgcctgctaatgcccctgtgctctgggaacgggcatacaacagtacgctagtaagaacgtctcaaaaccatcttcggctgagggagtttcactctttcctccaatcttttttcttcacatcggatgagaaggtttttcatcgccagaaatatccaaaccaatcttcgggatctgactgtccgctccttctccccacaaccacccctgctcgacctccctccctttccccacactccctagcttcgaagcttaatcacctccttcttaagcctccgtgatcagattcttcgcggggaaaagaaggagccaaaatgaccaaatagacgtaaagttactaggacactatggtctcacttccatagcagaaaatcaatccacccaataatcctcaatggtgtaaatggtagcacgttctgttgacaccttgatgtaacagcatcaaggcccgcttgagggtggaaggtctagctaactgcgctagggagtgccttgccagttctactaccttttctaggagcatcgcgatctaaagcgggcaggcatcgaattttcttttattcacagttccccatatggttgcaagaccctgttgatcttccagtgaggtttgggttttgcaggtagtcaagtggccgagataaaacatggcacaccagagctcttttcgtacaagctagaaacctcgttctcttattaataatattgcaaacaataacagtaaaataatagattattctatattatttagctccatttagcttgatattatattaataactgggttaattattgtgatattgtgtcgaaatatgaggccgtatggaggctttggtgtgccatgttttattttagccacttggttgtgtgtacgaacggccggggtttttccgatgaatggccccgctaccttagtcatcataaaaactttactggtaggcagaaataatcccagcccacaaaaacacttcctgttctgcttctttttcacgcgtctcgcagcatatgtgtgaagccgaatccttctcgttgacctttatatctggtaggtgatttccatcgttctgtttcttgcaatgtcgctaccaagcatcatgatgattgtttctattgagaaataccgcggcttatgacactcgaaagagtctttgattacaaccatatttacaacaacattcctgacaaaatgcttcccatcctcctttgctcaaccacagcttccattttcttcgggcttgtgctaatatcgcatagacactaggtccttgagccgatttctttcccgctgtctcgaagcagcaatcaacttcgaccggtcgattctacaatgctaaacctgccagagttcatcctcagccagcgtctgtcgggaacccggggtaggtaccgatgcgttttgactcttccgtgatccgtcctctggtctggcgatgtacatttcagtcccctgagagccaatgttggtgacattttgcccacgagcttcatcgttacacctccagcatgtcgcctacggtttggtcgtatttaccgtatcaatggggctgtgacgaagtggaatgaccgccatctcttccccaaacttggataatcgtatgcttctctgcttcgcctgtcatacgttatcttgcccgtatcatcttagcactttcgtaaaccaccttgtcgtagggctagaaaggaggagataaacctcgttgaatgaattccaataagatttacgtgggaagatgagcccattaggctggactgcgaactcgtgatgagattcgcgaacagtgtcctggccaagtgataaagggtaccgtaggcttacgtcctgcaaatagcggcagttgatcgagtgggagcaacccgaaaaaccacctaaggcacgcagcgcgtgcatgagaaactgttttggctgaaatgagagactgcagtcgcggcttccgacgagtggcacgagatcacgtaattcacgtcagggtagctttgattggtacagaaagaatcagcgcggcagcttgtctcagttgagtgcaaaaaagaaatcatgtacgtagctacttggcacatgaatcgtcattattaatggagaagaacggcagtggaaaacatctttgatcctaggcctcaccccgtagggtagttttatcagagatattaccgttcacgaaaagcccaccgaagtctttcaacatcacttggcggaatgcatctcttgattttattgcctcgttgacttcaacgtgattttttggggtcaagttggtcgagttggccagttgtcattgccggcgtttgatctcggaccggaatgtcgtcgcgtcttgctcttcgccatggctcttcaaatcccgctgaagctctggccaacgagctcttggccggcatactcatctagcatggtcatgggcaacaggccgtgctcgatagatgttcatgatacgtttgggccgacagtggcatactcgtgtctcaacggcttcgatttcacgctgctttttgaagagagtgttctgactctattgccacttttgctcaccggtatggggacgacggaagactgtctttttctcccttactttgtttagaggttgttcgctaagccgagtctctagttgtgatactcatcccccgcgcgattttccttcgcaagactgccccgaaggccaaacgatcatggctgtttgctctaaaatgtgtacttggacattcgactcatgtaatacgcggacaggtggcggctaatcggtcaattctctaggtgacatattccatctacatcgtgttacagatcatcctgctggttcttctggctcgacaggacactccctccaccagactcaccgtgccgctagcagtcgccgtcgtcgctagtttcatctggcttctctacgtctcatatctggagcatgtccgatgtgtgaggccgtcgaccattctttgcctctatttcggcatctctgctctgctggatttggcgcgtttgcgtaccctcttcttcatcccggactatcatataacggcactggtcaaccttacaagctacgctgttaagctggtgctgttggtcctggaagtcactgaaaagcgaagtctgctgttgtggcagtggaaagatacgtcgcctgaagatgttgcctcttattacagccgagtgttattcctctggctcaaccgggtgtttatcaggggatacaacacgcgtctgactgtggacagtttgacgcctttagaccaagatattttgaccgcttctcggcctacaaagttggagcagaggtgggcaaaaggtgagagctccttagctgaaatgatcctttctatagcaagtctcttctttaacacgcatgcattatagccgaaaaatcgagcaagggcgctttgctctgggtctttgtatgccattacaaatgggccctgttgggtggtgtgttgccgcgcctcacctatattacattcactttcgtcgagccgttactcgtggagagaaccttgaatttcacctcggaacctgagagcccgaactcgacaaacatagcctacggcctcatcggggcgtatgctctcgtccaccttggcaaagcggtacaatcgaatcctgaacattctctttgccctgaaggtgctaataagttcccactatgtagatgtcgctagcctggtacgagcacatgacatatcgcgccctgacactgtttcgcggtagccttgtcacgttgatcttcggcaagactcttcgcctgagcaccagtgctgtcaaagacgccgaggccatcacgttgatgagcgccgatattgatcggatcggtctttccatgcagatcattcacgatgcttacgccgcggtcgtagagcttgccttgtctctttggctgctctccaggctgctcggcatcgcggtcctgcctcctaccctttttattgtcggcaagtatgaccccggctcttgttcgtaagctgagatggatgatagattgctaacatgttaaaaagtgtgtcttggctttggaattcccattgcctctgccgctggaaacgcgcaggtgccatggctcgaggcgattgagaaacgcttggccgtgacctccaagatggtggggacaatgaaggtgattcgaatgaccggcttgacagaaactatccacgggattgttactagtctccgaagcaaggagatccgagcatcacgcgccttccgtctcttgtccgttctacagactggcgctggtgagtcccatgaacttccccacgatgtaaatctgactgacttgaggtgtcggacagccaattgcacatttacctttgctcccgtcctgggtctcggaacctttgccatcttggccaaagtcaacaacacggaggcattgacagagggtatggcttttgcagtcttgagtttgttcaatctccaggaccgacccgtcatgtccttgcttcatggcttcgaagatttccagaccatatacaacgccttttatcgtattcagacctaccttctgtccgccgagagggaagactcgcgagcgacccctctttaccaacaacccgaaacgtcatccgatgaaagcctaccgaaaatctctactacagtggcatccggtcacggcgttctgaccaaggtcgttgacaacaattctgaaaccagcgttattcgtctcactgaagcctcgggaggttatactcctgaaacaatgatcctcgaaggaatcaacctggggattagtggcggcaaggtgaccatgattgtcgggcctgtcggttccggcaagtcaacactgctgcgccttctcctcggcgagctgccccaagtgtcaggctccatcgtctcggacttttccaaatgcgcatacgctccccaatcaccatggattacgtggggcacagtacggagcaacatcctgggaatgtcgccgtgggatgctgggtggtaccgcaaagttgtttgtgcgtgttcgctagacggcgactttgaaggtctgccagatggtgaccagacaaaaactgggatccggggctctcatctgagtggcggccaacagattcgtgtggtgagtaatgtatctttctaggtacggtctgggaaggggaagaggagctgacaggagacaagtcgttggctcgtgctttgtactctaggaacaaactccttgtgttggatgatgtcctgacaggtcttgaccggacgactgaggccgctgtgctagaggccgtcttcaatgaggacggcatcctcaaaaatacgggatcaacgatcgtgcttgctacaaattctggtatgttgactctgacccatacctctgtcctgcactgcttatgggatgccctatagctggccacctacgttacgccgaccatataatagttctcaacacggagggggatatcgctgagcaaggcactcttgaagacgtttccgcatccgggggctatgtgcagcgcctggagagcttgccagttgctgagacgtcccgacaggaaacactggaggtgccagaggaagtatatcaggagctcggcctcgagaatgaggacgacgagctagatgcttcccatcgggcgagtgactggcaggtgtacacttactacatccgggttgccggtgtatggaccttttcagcctatctcgttatctgcgcagcgtatatatttggcctgagctttccctgtaagtgaattcacaacgtcatcattcgttagactgctgactctggtggctccctctagcaatatggctgcaatggtggactcattacaataaagaacatcccaacgacaacattggctactggctgggcgtatactttgccctcgcaagtttagcgattgcagggtgtatggcatccgactggtgcgttgtctttttataacacgggactggtgaagttgtctgactcccctttagggctttccgaatgatggtggttccaaaaacctcgcgcaaattccacgagcttttgctcgatacaactatgtagtatgatgtctcggtttcacctggttgagactcatcagtggctaatattcctcgtcctttagcgcaacaacatcgtttctgacatctacaaatgtcggaatcaccacgaaccggttcagccaagacctgcagcttatcgacagtgatctgccgcagtctctcgacgagtgcgtcatgaactttcttggtgtcttgatctcggccgtcttggtgtttaccggctctggctacgttgccgctactatccccgcctgcgtggctgtcatcttcttcgtccagatgttttatctgcgtacgtcacgccagttgcgtctgctcgacattgaagccaaggcgcccctgttttcccacttcattgagacgctgggcggcattgcctgcattcgcgcatatgggtggtcagaacagtacatggaccggagctacgacgttcttgacgcctctcagaagccgtactatctaatgtggtgcatccagaggtggctgaccgtggtgctggacctgttggccggcgccatcgccgtaatgctggtcgcgtttgcaaccctggtgcgcaacgggtcgactggactgctgggcgtggcgctcttcaatgtcatcagcttcagtggcgctctccagtctctcgtcacgcagtggacacagctggagacgggccttggtgccatcagtcgcgtcaagacatttgttgaggagaccaaatcggagaaacgcgagggagagacggacgacggcttgccagatacttggccggcagccggttatattattttggataacgtgtccgcctcttacgagtcatctactgctcctgtcgtcgatggattcaacttggccatccaaccaggtgaaaagattgcattgtgcgggcgaacaggaaggtgagttcaggtctgaatatgatgttttctgctaatactaactgacaacgctgcagtggtaaatcatcactgctcttggcgatacttggtatgctggacctaaatgagggcagcatcaccattgacgggtacgccaccggcaagatatcgcgcgagacactgcgcagccgcctcaacatattaccgcaggagcccttctttctgtacgggagtgtgcgcgagaacatggacccgctgcacatcttgactgacgaacgtattatcgaaacactacgcgccgtccgtctctgggacctgctggatagccgcggcgggctcgacgcctcaatggacgaggatgctctgtcccacggccagcggcagctattctgccttgcccgcgctattgcacgcccaggcaaaatcctcatcatcgacgaggcgacgagcagcgtcgatgcggagacggatgagcttatgcagcgggtgctacgagaagagctccagggccgcaccctgatcgccattgctcacaagctaaacacagtgctcgactttgatcgggtcgtgctaattgacaagggcaagccgatggaatctgggaacccacaagagctcctggccgacccagcatccatgttctctaagctatacaggagtggaagtagccaagccgcgtaaagcaaaccgtggcggggatgagcggaggactgagatctttcgttagtctttactttttcgatcgagatccttgctgtaaggacatatctctggagctacaccccccctacaggcgagaggattgaccaaaacgggcggctgggcggatgagtcgttgggcagctagtttagaaaggcatagcatgtacacaacaaactcacttcctcctccacagtcggtccccatggcgccgtacaacacgtcaggcgtggatcattgtaggtactttgatccatgttgtggagtcgcatcggcacattgttcttgggcctgaccggcagtagctcatccatggactcatcaatacgagaacaggtgccgaaaatgaaggaaccagactccgcttttcgtgtgggatacggcttgtgagcgagtggctgagacgactcactcccatctattgcccaaaggccaagcgcttgccttctttgcatcaccaaaaggtccttggaggtctttcatcgcggttgctattacctaacattacctaattgtgtgacttaggaattgaccgccggagtcaggggttgcagccttgtgcatctgcatacttggacacggaacattggcctggcatcggctggaagtgctcacacccgtcgttgtctcattaatggggccacaaaaggcgccattgggacgccgagacactgatcatcatttatgatcgtacgtctagcaagctacctacatatggataggcattaagtaggggtaaggaccccagccgattggatgatgttgccgcctcaattttgtgacaatgcgggtttggagcctatcgtcgatgagcacatctttacagaaactgatacataatattccgcaggtggactagactagatcggcggcatcttctgttctctcagtggccaccgtagctgtctcagctcttcagctcgccacaaagagctacctacctaccttcaaggtacactggcgtcatgtgttcttgcgagacgagacttggtctcgtaatactgcagtcatctatcacacagtggagcccaatttcctttcgatgcatttgggtgtacgactgcatagcacatacttcgtggtagtagatgtattattttgcgaagtccaaccaagttgtactgtaaccttgaccccttactgtccctccgcatattcttggcatcatgtttctggtctactgcttcccattcctagacctgcatgaccagaggaaggcaatagagatgatgcaagcttgtgctcaatttatgaaatggcatgaatgtacgtaatgtggatactactaagactacatacctttagtgagttcatgggcattgggtagaatgatgtattagctgcgttgctttttgcaaacaatcaaatccaaagaggcgcagtaaagacactgacagctcacttgcagcctcatgaagtaattagatgaccaaattattcaaagaacccagctcaccggctgaacagatactgaaataaaatcctaggtttcagacccgtccatgcccgcccactccctctctgtcagcttgtgaaagcccagatcgcaccgctggccgcgcggcatggcgttctgcgttccgagctgctccatggtccagtccgttgttgtctcggactgctgatcccgccgcacgctgaactcgaggaggatgcctgcaacgagctgcttgatctcggcgacggcaaaggcttttcctagacagaggcgcgcgccgtagccaaacggcatgtagcacgactccatggcctgtagggttgccccgtcagcctcgagccagcggtcgggtttgaacttgtgtggatcaggaaagacgtctggtctgtagtggatggagagtgtcgatgtggacacaagtgtctgttttcatcttatggttagcatacacaagaaattgaacaatagcgagggtggtaaactgtcaggaagaagaagaagaagactcaccccggctggaaggacgatgccgctatatgcctttgtagcgggcacaaccctctctgccctgccgctcgataaaggatggaggcggccggactctcgaaagcaggcatccagaaggcgacaagccatgatgctgtcaaagctgggcaagccgtcgccctcgttgatgggcagcgagagaagctcagtgcggacccggtcctgccacccgggcttgcaagccaggtcccagagcaaaaaggtcaaggcgagggccaccgtcgtctgcgccgcgtggatgttgtccagcatctcggccgcgatccacgacacggggtaaggctcgccctcgggcgtcttggagtggctcagctggtggagaagggagcccggcacaatcttgcccgggtcacgctggctggccatgatcttgtccatgttccagtcggccagcctctcctcggcggacaggaaatccgggtcgcctctggtatgggtcaggacggcccgggtgatcctgtgggcggtgggcacgatgtatgcgaggttattccagacctcgacttctttccagcccgctaatatcgttcgctcttcgcagttctcatcgtcgatcgagtgagcgcagagctcgggcccgtatgccaggcgtgtgatgttgtcaaacgagtacaggttgcagtaaaacatggcatcgaccgtcaagcgcgcctccatgtctctcttgagccggtcaacgatcttggacacgttggtgcgcagagggtgcaaggctgccggcttgtagatggacgagggctggtagaaggcaaacgtccgcttgcacatctgccggtgctcaccaacgccgcggacgcaaaagatgggccgctggccgtacattgtaaagttgtcaaagtagctgctcttgggatgacgcccggagcagccgtaaatgtcctttgtgggcgccgggctggaaaaggagacctcgctcggggcgatgagaacgacgtcgccatacttgcagtgccactcgtgaatcttgctaatccgacgcagccgcaagtcttggtagatggcccagtagcgtgtgattttgcacagcctcggccctggaatgttcctgtacggcgaaaggaacaaggcataggtgattttgctggcaatgaaagcaagagagagggctagaactacgccgaggatcgtcaagagggccattattgcgcttggtttgtctgtcgagcgagccagaatcgtataacaaaggttgaccgctctaattccaacttcaaaaagagcaagtaacaataagaagggcttgaatactgatcaagtccgagaaaaagatgaaaaaagtatacgctgtatcaagaaataaggaatgccaaaaaaaggtaccttttatacctacaccatacacgcagttgcttgctcgggtcagaagagctcggaggacagcagagacctactagagccaaaaggcttcgatacaggcaggtttgcaccatgtctcttcaggctgaccgatgcccctttggtcgaatgaatatcgacccggcgggagcactcggggggtaaggttgtgggacagtttgcatgagatcactctgttgctgttggagcaatagctctgtacagagttttcttccgagagatactccccgggcagtctagacacgaaattctcgtcatttatcgaaaatacctaaaagtacatatacatacgagactaaaggactagccactaagatgggatttgctacaacagtaaatggccattggggtagatttttgataattcccaattcaacaaccaactgttgaatggttgtcggatctgggagccaagaagaaaacactgacttgggaagttttctatttacatgatatggcctatgtaagtaaggtaggtacctattgtatgaatttgcctaatactctgccgtttgccgttactcgatcgctctagacgaggcccaaggcgcaatagacaagccttgcattagcaagctgatcttgacagaactcccactgaaggcatggatacccaaggccgcgcaggactgaatcatttattgccagtgagtctctctggggatggtcacgagatggccacgttccaccgagtaagaaaatctccgcttctagacatccaaggtggtgtgatggcatgctgccacagtccaagcgatctacatgtacaagctacagtggagtacatgtagttatgaaacgaagagctcggcctcactcttagttccaccgtaatgctcctcttaagatgcaatggtgatctagcctttgtgatccggagagctgaacggaaggaatcgcgttttcacgcttcgcttagaccatgatattgtataaatgccttactactactgatagtgcgtagtagtttgtccagcccgcggaaatccgcgttgctataacgggctggtgaataggcacatttggcaacctatatggagtatttactgcaccgtcttttctcgtgcctaggccgtgcggctgaggatcgtcaaatcctttgccaggaatcacacaactactgaaagccacttgggatgtggggtgtttgtgaagccaagaatgcggaggggtgtgtgacatgagccaggtgagttacttgaggaaagatgtgatgtgatgcatgcgcatgtctcagtctcaaagtctgtcgtgtgcaaccgcgcactgccattttcgactactcacctgaaaatgcagcgcgcctaaccgagcaactatgacgatgactatggatgatctagctacagattgataatgggcgcccaaaagttctgtctggcgcaatgcgctgcctgaaattttacgcagtacgagagacatacatgtgcgtgtcgatataccggtacccccctcgcacggtgcctggaatacacatgtgctcacatacccatcatgtgtaagtgacgagtattgcattgcgtattttcagtccaacatcatcggcccaagaatttgaaattggctgcttacgccctctttgcgacgtctcatcttcctctagcaacaccgtcatcatcccttgacgaaggtgtctaagtaaaagcttggccaaagccattcacaaagaggccgagatcgcattgtacaatatcgttgagaatgcctgccaatgcctcaaacaagaggcaagatccttcctcgtcattgctttacaacgagtctcagcacagctcgacagatagcatcagtcgtcaagatcttgagctcatctggaaatggaatcataccgtcccagagacagtcaaccaatgtgttcacagtcttatcaaggagagagtgcgcctgcagcctgacgaccaggctgtccaggcatgggacggcaattggagctaccgccagctcgatgaactctctaccaacctagcacatcgcctcatcgatattggcgtcggtcctaatgtaattgtccctctctgctttgaaaagtcaaaatgggcccccatcgccatgctcgctgtgatgaaggccggaggtgcatcggtggctctggaaacctcactccctttcgagcgtttatgtagcatcgttcaacaaactaagccgattgttatcctggcgtcttctttgactgctgatcttgctggccgcctcacctcgggcatagtcgtgcttgttgatgaggaaagcaccagcccctccgtgacaatcaacaaactaccagaagttcacccatcaagcagactctacatcatcttcacctcgggcagtacgggcacgcccaagggcacgattattacccattcgaacatttgcactttgattcaacaccaacaggccgtacaaggctattcagtttcttcacgggtgtatgattttgccaagtactcctttgacgtagcttggtccaacttcatccataccctgactgtgggcggctgcctctgcatccctccacagcaagaggctatcagcaaccttgctggctccatacgagcatacggcgcaaactgtataaacatcacgcccacagtcggtgccatgattcgaccatcggacctgaatggtacaatgaagcatgtgattttcgctggggaggccctgacgagccagctggcctctgagtgggcacaaattacccgcgtgttcaacttgtacggcccagctgaatgcgcaatcggagcgacgctggctgaatttggcgatggcggcgctgctagcaagcaagactccaatgttaccattggccgcggagttggcttttgcacttgggtggtcgaccctgactgccatgacgagctggtgcccgttggagccactggcgagttggttttggaaggtccagttgtcggagatggatatcttggagatccagaaaagacggccgcagtgttcatcgagagcccgaagtggttggttgctgggtcgccaggctgtccaggtcgtctaggtcgactatacaagacaggtgatcttgtgcgctacgaagccaatggcaatattgcatatgtaggccgaaaagacttgcaagttaagatcaacggccagcgtgtggagttgggcgacgtcgagtctcacgtgcggacagaggtcgctcatggcggaggggatgtgcgagtggctgccgagctcttgacaccacgcaacagcgacaggtctttgcttgttgcgttcatacagatatcgaagtcagcttccagccaagacaaggacggactagaaacagaggtgcagagagtcaccgacggactcaacaaccggttggccgtccatttaccggtatacatgatcccggcagcctatattccgcttgaggttttccccacaacatctagtgggaaactggatagaagcaagctcagagaaacgggggcagcattttcattgaaggagcttatgactcaaggctcatctttgccagacaagagggagccaaccaccgttatggagctccgtttacgaggtctttggtcctctgttctgggtttggatgacgacagcatcggagctgatgatgactttctacgccttggaggggattctattgcggccatgaaactggctggcgccgcgcgagatgacagcctattgctcaatgtcgccgacatctttacccatccggtgctgtgtgacatgtcaaaggtcatagccgagcttttagaggatattagtagccccatcgagcctttttctttgctcaaaaaccatgtcgacacggagtcggtgcgcagacaggcggccgtcgtctgtggcgtcgccactgagaatgtggccgacgtctttccctgcacacctctacaagagggtctcatcgccttgacagccaagcatccaggtgactacatctcccggcatgttttccagctgcagcctggagtgaacatggagcgtcttcgaaaggcatgggaacaggtggtggcggcaacagctatccttcggacgcgaattgtcgacatcaagccccaaggaatggtgcaggtggtcattgatactaatgaaatgacgggagtaatgcacgaggagcgacgcatgggcctcgccaagtataagcagatggatgaaaagctcacaatggacttgggaagccccttggtcaaattcgcactgttcgaggaggagcgagaagatgagaaagaggcgagacgtttctttgtgtggacgatccaccatgcgctatatgatggatggtccaaatcactacttttaaagcggctttcccaagcttatattggtggggaaggagagcttgaggattttactccatttcaaggtttcgtgaagcatatcctcaatatgcaggaagacgaggcaaccaacttttggtcgacgcagttcagagacattaatgcacaaatatttcccgcactgccgtcgccgcgttatcagccgagatctgataccttggtacagtatgctattgaagatctccagtggccaaatgcgatgggtatgacagcttcgaccctcttgcgaggcgcatggtccatcatcacctcatgttatataggtgcaaatgataccgtgttcggcatcaccgtgagcggcaggcaggcagctgtccgaggagtggatgggatgactggtcccacgattgcgacaatgccgctgcggattgtcttggataaggaaaagactgtcggagaacttcttgtccaaattcaaaatcaggtcctcggcatggtaccatttgaacaaacgggcctacaaagaatcaagcgggtcagccctgaagccgagagagcatgcgacttccaaacgttgctcatcatccagccagccgaggatgagacggagaggtcgtgtcatgatcgtctctttgtacgcgagggtaattttgagaaaacatgcgaaacggaaaacgaaatggcagagttccgcacatatcctttgtctctagagtgccacctgcaggagcaaggcgttgttttgtcgacaagatttgactctgctgtgcttcaacacgaccaagtggccaacatgatgaggcagctggaacacgttgtccgccagctgtgcaattctgaacatgcagaggtcaaattgggaaacctgtctctgatcggtcaagaggatctcgcccagatatggcgctggaactcaagcgtacccgagacggccgatggtgctgtgcacgacttgatttccgctacgacgaggcagcagccgaatgccgaggcagtatgcgcgtgggatggtagctggacgtatcgcgagcttgacgacctgtcgacgcgtctggcacgtcatctcgttggtctgggtgttgggcatgatactattgtcccgctaatcgtcgaaaagtcaaaatggatgcctgtagccatgatggctgtgatgaaggccgggggagcttctattgctctcgacgacacgcagccagaggatcgacttggaaatatcgtgcgacaattggaaccggttgtggtgttgacgtcggctaagaatcaggaccttgctcgcctcttgagcccaatggtcacgtgcaacctggctgtggtcggtgaggagcacctgcccagtcatccttgtgcttcaacaactacatcatcaacaccgacatcatccatagcactcccaaaagtagactcttcaaacagactctatcttgtcttcacgtccggcagtactggaaccccaaagggtgtggtcgtaactcatggaaacattaccagcgccatccgccaccagcggggtacccttggattcactaaagaatcacgagtctacgactttgcatcttacacgttcgacgtggtctggtgcaaccttctccaaggcctctctgcaggaggttgtctctgtatcccgagcaaccatgatcgccgcaccgatcctctcggcgccatcagccgtcttggtgccaacacgaccattttgaccccctcgactatccgcggattggacttacagcccctccgggatctacaccacattctcttcatcggagagccactctcagctgatgatctaaaaagcttgcatcctgacgtcgccataactaacctctacgggccaactgagtgtaccacgttcagcacggcccaacgcgtcgtccttcacaagtcttcagacctggaaaagcgccaacccattagcataggcaccggcttaggtctacgaacatggctcgtacagccttcggatcactcaaaattagttccagtggggtgcgttggcgaaattctgctggaagggccgcttgtggcggcggaataccttggagacgacaaaaagacggctgatgccttcatatacgatccagtctggctcttgaaggcatgtcccaatcaccgtggtcgccatgggcgtttatacaagactggggatcttgcacggtacgacatggatggaaacctgattttcctaggacgtaaggactcccaagtcaagatcaatggccagcgtgttgagctgggcgatattgagcaccacgttcgatctaacattcttcaccgtcaaaatttgaatactacagtcatcgcagaagttgtgacgcctcaggacagcagaaatgcaatgcttgtatgttttatacacattggggctactgaggtatcctgtgatgaaaggaccgtacaagatgcgttcgagagcttgtcgaatagccttctcgacaggcttgttggcaaggtaccagcgcatatgatcccagcagcctgcattccactcagcgagatccctatgacgcccagtggcaagattgaccgtggtaagctccgtgcgataggtcaacaaatggacttggagagtctcgtaggaaccaacttgtcccccaagtccgcgcgatcagaaccgtctacaaacaccgaaacgcgtctgagggatttgtgcgcagttgtgctcggcattcacgaagaaaatatcgctatggacagtagctttttacggataggaggtgactctatcggagccgtgaggcttgtcgcagcagcacgccagcatggcattaatttctccgtcacagatgtattcgagcacccggtgctaagggacctagcccgaatagcttgtgtccctgctaacgagactgaggaacttaaaactgaaccattcaaactgttaagaaatgtaggagtgacgaaagacaacctcaaacagcgaatcgcacgtgagtgcaatattcaggctgagcaagtcactgatgcatttccctgcacccctctgcaggaaggcctgcttggattgactgccaagcgagccggcgattatgtggcacgatttgtttacccgctgcaggccagtgtagattacgagcagttttcgaaagcatgggaggccgtcgttgcagcagtacctatcttgcgaactcggtttgttgatctgggtgatcttggcttggctcaaatcattgtcgatgaaccaaccaattggtcattcaagaacgagttgattagtgtcaaagactatgaattggctgataaacagcttgaaatgggcctgggcttagctatggcacgatttgccattgtgaaagacccagttgatggtagacgtttctttgtgtggactattcaccatgccctctatgatgcctggtccatttccctgatattggagaagctggaagccacatatcattttaatgaatgcggtacaatcacgccctcagtaccgctacagacatttgtcaagcacgtaatggacattgaccagatcatggcggctacttactggagtgagcagtgtcgtggatctgaagctcaaacctttccgtcgcttccctcggccacttatgagccaatgtctagtgccttcttcaagcatcgcattagaaaactccaatggccaaagactgatacgacgcctgcatcaattttacggacagcctggacgcttttggctgcaaaatatactgctagctccgacatcgtctttggtgttactgtttctggtcgacaagctcatgttcccaacattgagcaaattgtaggacctacaattgccacagtgccagttcgagttgcttttaactggactgaaatgactgtggaacatcttttacgtcaagttcagtcccaagcggtgggtatgacggcttttgagcagtcgggtttgcaacgtattcgctgcgcgagcgtggaggctgaacaggcatgcagattccagactttgctcgtcgtgcaccacgtcgaggatggcgaagacaaagggaagagtagctggttcatgagcaaccgggacgaagacggagaagacgacaccaacgtcaccgatcatgatacattcgccctgactattgagtgtggtctggaaagggagggactcaggctgcgtattgcctatgatgccaggattttggatgctaagcaagtcgagaggctggctcatcaactcgagcatgccattcgacagatttgtgttccaagcaatgctagctgccacctgggtagcttggatatgttaagcgctcaggatttggatgatatctggaaatggaacaacatctgtccagaaactttgcacacttgtctacacgatatgatctcacaaaaagctcaatcaatcccggatgacccggcagtcaatgcgtgggacggcgacttatcctatcgcgaacttgacgaggcatctacgtgcctggcgaattacctcgtcagtgttggcgttggacccgagacaatcattcctctgtattttgaaaagtctatggtggcgcccgttgcgatgctagccgttatgaaagcaggcggtgcgccgatcatgatggactcgagccaaccgcaagaacgtctgcaagtcattgtcgaccaaatcaaccctgttgtggtggtgacttcgttgagtaacagagaactggcgagcacactcaccgtggcacccatcattgctatcagtagtgagcgtctagagcagttgcggagtgagcaaaaatgcctgacgcagcttccacaagtccagccgtggaataaagcatacttgatattcacttcaggtagcactggcgtcccaaagggggtcgtactcactcatgcaaacgtgtgtagtgcagttcgccaccagcagctcgctcaggggtacacccctgattctcgcgtatacgacttcacttcgtacgcatttgacacaacctggaataactttatgcatacatttactattggcgcctgcctgtgtattccgtcagagaacgaacgcagagatgatctcgccggatctattgagcggttcaagccaaccatcctcgacatcacgccatctgccgctacggtcttggggcacaataccatccaatccctgcgtacaatgatcctgggaggtgaaagattgtcccctgagtacgctcagcgttggggagcactcgtcgacctgaagctctgttacgggccatgtgagtgtacgcccacggcgaccgttgccacagtcgaccccgacgtggatggcgaaccacctcttggccctgccatcgggatgtgtgcttgggttacagatccaacggatgttgacactcttgtcccgattggcgccatgggcgagcttgtcttggaaggcccccttgtcggtcagggttatttgaacgaccacgtaaacacggacgcgggtttcatcgatgacctaccctggctcctgcgcggcggacctggcaggtctggacgcaagggccgcctttataagaccggcgaccttgtgaagtataatccagacggttcactgatgttcatcgggcggaaagatgcccaggtcaagatcaacggtcaacgagtggagctcggcgaaatcgaaaatcacatggtccgtcactcactgacgcgccaggccgtatctctgtatcctcggtctggcctttgctcgagaaaactcgttggaatctttagcttggaagacgtcccagaaagtaataacttgtcaccgatcgaacttgtcaatgcaaagcatgatgccgctattcagcagcatattctaacgctgcaacaaatcttaggagaggctctgccttcatacatggtaccgtctatatgggtccctcttaagaacattcccctgaatccttcaggcaagctgaaccgccgtctagtggaagactggctgatcaacataagcccaaaaagtttctctagaatcagtaacgcgggctcctcatttgtaactcgtggacccgagacgcacgccgagcgtgttatttacgatgcttgcagtgtcatcttgaacattcctcgtgttgatgtgaatctggggcgttcatttgttgccaatggcggcgactccatctctgctatgcgcctctcttcgcattgccgtgccgtcaaactggccgtttctgtaagagtgctgctaaaaagcaaatcacttgttgatgtagcccagctctcgactgccgccactggcccagacctatatcgcgctcaaggaggcgaagaagtttttggcaagggcttcaagttgtcgcctatccaaaagtggttcttcggccagactccacctgaatgtgtcacgaaggaaaactatcactgtaaccaagggttttatgtcaaaatcaaccgtcatctttcgactgaagacgtctccctggctattcgtaagatcgtcgggcagcattccatgctccgtgcgcgattccactactccaatgaagaatggatgcagattgttcccaagccagaagatggcttttatcattttggctcctttgaagcccagtctctggatgaagtgaaatccaagacaataaagagtcatcgaagcctggacatcgagcgcggcctagttttcgcagtagatctatacacgttgccatgtgatgaccaatatttgactttgatcgcccaccatctagtcgttgatctcgtttcatggcgcatcatattacatgacctcgaggctttacttaccggacataagcttctcgatggacttccctttcagctctggaacaagctacagatgaaggaagcccagtgctctacgttcctcccggacaaggtcctctctactactaatgtgcacaataaccatagtttttgggattttaacgagaatatacccaacaatactgaggaccatatagaaatgaatgttgaggttgataaagccacgaccgcactgatgctcaaaggcgcgaactctgcgttcaacacggagcctgtcgacctaattctctcatccatctggggcgctttcttccatgtgttccgttcccgggatgggcttactatttttaatgaaagccatggacgtgagccgtggacaacagatatcgacttatcacgtactgtaggatggtttacaacaatctgtcccatccatgtctctcgaagcgagggcaatagtaatgccaatattgtgaggacggtcaaggatgcccgacgccggttaccctccaatggctgggcttactgggtgtcaagacatatgaatgagaagggaatggctgccttcgcatctcataactctgttatggaagtccagttcaattatcatggacagttccaacagctggagcgcaccgactctctctttgatgcgtgtaattttgatgacaaggtatcggccgttggaccgtctcttccgacatcagtcttgtttgatattaacgttgttattgaatctggagtgaccaagatctcatttgcttggaaccgacatcttgctcaccaggatttgatccaagcatggattgcacaaatcagcccctcaatggaaaacatatgtgcagaactagccaacagacaagctcagaataccctttgtgattatgagtttgtcagccttgattatagagggctcgaccagctccatgaggacattttaccccacattgaaaaggtcaataatgcacaaatcgagtccgtctacccatcttctcctatggtagatggaattcttctcagtcagttgaaaggtacaggctcctataaaacttcgcaaacttgggaaatacgacctgtcaaatctggctcgggtcgccttgacgccttgaccaacgcgtggcaagcggttgtcgctcgacacccctctttgcgaactgcattcattgatagcatggatgcctcggttgcatacaactcagttgtgctaagatcataccgtggcgacgttgcccttctaaaagagcagagtttcgaatctgccattattaggcttagggaactgcccgaagccaactacactctagataggccggctcatcgattggtggtttgtgatatcgccgaagatagccgtcttgtctgcaaaatcgagatgagccatgcaatttctgatggtgcttcaacggccatcaccatgcaagattggggtcgggcttactctggggagctcaatatagaagaactaggtgacaccagtgaggaattcgctcgagcccttctgtccgtgacgaaaacggataagatgacttactggaagcagaagctgtccaatacggagccttgccttttcccacgtcttactgatgctgggctggtagccgatgagcatgatgccggagtagccatcttagagctctgcaaagagacatttgatcaggttcaacaattttgcaagtcacagtctgtgactcctgccaccctgtttcagagcgcttgggctcttgttctctcgagttattcaggcaccgactctgtctgctttggatatctggcatctgggcgggaatttcccgtcaagggtatagtggactctattggtgcttttgccaatgttatgacctgccttgtaaatatttccccagactggagcggtgcagacttggtccaacacatacacggtcaagtcttggaagatttgggcttccaacattgctcgattggcgatatacagcacgagctaggtcttccattcggacaaaatcttttcaactccatcatatcatttcaaagggataacgatagcctcgacggaagcataataacccgagatttggtgttcaccaatcttaagtgggaagatccgaccgagtatgatattacgatgaacataagatataccgacgtttcggcctgcttcacgcttgaacaccgaatggcgtgtatttctaatgaacaggccgatcgcgttgcttcacttctggaaaaaacgatcatatctctcgttggcgagggcaatgtggactctgtcgccgaccataaggcgcaaaaattggctgaaatggaaagcataaccgacaaagacttgcgagacatttggaagtggaacaaggctgtgcctgaagcagtcaatggactcgtacatgatgcaattgccgacgttgttcagaaaaatcccgattcgcctgccatctgtgcttgggatggtggtttcacgtatgccgagatggatgctcttgctacgaaactcgcatattaccttgctacatttggcattgggcctgatgttattgtgcctttgtattttgagaagtcaaaatggatgcctgtggctatgcttgccgtcatgaaagcaggtggtgcatcagtggcgctggacagcactctcccacaggagcgcattcgcaacgtcgtttgccaggtgaatcctatagttattctaacatcctcggcaaatctgcaaatggcaaaccgtctcacaggttgtgttgctatccctgtgagcgctacacaccttgagcagctcggcacagtccccagatcattgccggccatagacccatccaacaagctatatgtggtctttacatctggtagcactggacttcccaaaggcgtcgtcatcacgcattctaacttctgcagtgctattcggtaccagcagaaagctttgggttttagaaacacatcacgcgtatatgattttgtgaaatatgcgtttgatgtgacttggtccaactttttgcataccatgaccgcaggcggctgtctctgcatcccctctgagaccgaaacttctaataatatcaccagctccatgatctcgtataacgcaaatttcgctgatttaaccccatctgtcgccagcactctaagcccaaccgatcttgttacactggaccatctgttgttcagcggcgaggcgttgacaagccaccttgctgcgcagtgggccgagagagtgactgttctaaatacctatggtcctgcagaatgtagtgtcaaggcaacatttgaagaggttggcaaaactagtggtagtacatcagctgctagcataggtcgtggattcggtatgtgtacctggattgttaaatcgacaaaccataaccagcttgtgccgtttggtgctgctggcgagcttttgcttgaagggccgcttgtcggcgcagggtatctgggagatcctgccaaaaccgaagcggcctttatcgaggatccgacttggcttgctcgtggagggccgggctatgctggccgcagaggacatctttacaagaccggagatatagtacgctataattcagacgggtgcatgactttcctaggtcgaaatgatgctcaagtcaagattaacggtcagcggctggagcttggggatgttgagtatcatgtgcggtcgaatatcatccatgacgggcttgtgcaggtattcgctgaaatcatcaagccccagggaagcagaaagtctctcctccttgctttcgtttacactgggggaaaagtattgtcatccaataagcagcgcgttgagaagaccaagaagcttacagccggccttgatgagagacttggttccaaagtaccaagcttcatgattccggccggttatttgttaatagaccatattcccatgacaacaaccggcaagactgaccgccgtcgattgcgtgagatgggccaggagttgacctttgagcaagtcatgtcgctcaattctcgccaagcccaacacaagccacccagcacaactacagagaagcgtctgcagcgcctttgggcatccgtccttggtgtcaaagctgactcaatcagcgcaaatgatagtttcctcaggattggaggggattcaattggtgccatgaagctggtgggactttctcgtgaggagggacttagcctcacggtcacggatatatttaagcagcccaagctgtgcgatctggccttggtgttgacggaggtctctagcacagattttgacaccattgagccattttctctcctcgatcatgatattgattctcaggtggcgcggaataaggttgccgagctgtgtcaggttgatagctaccagatccaagacatatttccgtgcacgccgttgcaagaaggtcttcttgcactgacggctaagcgagccggtgactacgtggctcggtacgagatgccactgctggagactattgacgtgactcagttccaaaaggcttgggaagaggtcttacggatggacccaattctgcgaacacgcattgtcgaccttccaggccaagggttggtccaggttattctagagcaaggtgtggcttggacgcaatgctccagtatccgagagtatagagaaatagacgagaaggtcgggatgggattaggcaaggcacttattcgatactccgtcatccacgagcctgatcacaagcaacgttctgttttcgcatggacgatacatcatgccctttatgacggatggtctatgccgcgcattctacagaggctggaagtggcatacaagggagaggtggctcttcaggaggctcctctttttcaacgctttgttaaacacattatgagcactgacaaggaacgcacgaagagtttctggcagacacagtttgagaaatctgaggcccgagtgtttccttctttgccgtctcccgcgtatcaaccacttgccaactcatccatctcccactgcattagcgacttagattggccagacagcgatatcacagcatccacagccattcgcacagcatggtctatctcagcggcgaagtactcaaactcgagtgatgtggtttttggagctacagtgaacggtcggcaggctaatgtcgagcgagtggacgagatgacgggtcctacactcgcaaccgtacccgtccgagtggtattggattggggaaagactgttgagacttgtcttggacaggttcaagctcagtccgtggaaatggccgaatttgagcagacggggttgcagaatattcgtcaaatgagtgccaaagcgaagcaggcctgcgactttcaaacgcttttgctcatacatcctccagtggaggcagcgcattccgagtctgagatctttgcgcccaatgatcaaggtagtgatggagatgatggagacgtccaactatcagagtttgatacgcacgccatcacaattgaatgtgatttatcgcagtgtggacttaatttgaggatcgagtttgatcacaacatcctgactcagcgccggattgaaaggctggctgcacagatggaacatgttctgcggctattgtgtgatccaaaccaagcaaagagacgattaggagacttggacctgatcagcaagggggatcttgaagatatctgggggtggaacgttactgttccggaggcggttcagggtcttgtgcacgatgtaatcatcgcaaaggctcggaaacaacccaaagctcctgccatatccgcgtgggatggcaatctcagttatggggagcttgatgacttgtcgtcacgtctagctaatcatctgctgcattttggagtaggaccagaagtcattgttcctctgtgctttgagaaatccagatggactccagttgcaatgcttggtgtcatgaaggctggcggagtttgtgttatgttgaatcccaacttgcccgaggatcgactcttgagcattatgcagcaggtcaagccgaaacttgtgctctcgtctttggaaaacaaggcggtggccactggcctatcagatgacaagcctgtagttgtgattgatgaaaagctgttactttcactgggggtgcccgattcagaggccctacctaaagtgctaccgtcaaatacgctctacattgtcttcacctcgggcagtactggcattcctaagggtgtacggattacgcatgccaatttcagcagctctctgctacatcagcatagcgctcatggatttgacagcaggcctgatgcacgagtctacgactttgcgtcctatgcatttgatacatcttggcagaacatgctggcgacctttgactgtggtgcctgtttatgcattccatcagaagacgagcgacgcgatgatctagctggttcgattcaacgattcggggtcactcattgcgaattaacgccctcaaccgtcagggtcctacctttggcaaccctcaagtccctcgatactttgatcttgggaggtgagaggctgcaagatgagtgcgccaagaagtgggcacctctcgtggatctcaagaattcatatggtccttgcgaatgtacgccgacgtctaccgttgccgatgtagacccaaccaatcccaacgcagcgcgtataggcacgggaagaggtgtcaacacttggatagtagacactataactggcgagtccttggtgcctataggaggcatcggtgagttgatgctcgagggaccacttgtcgggcctggctatctcgatgatgttgacaagactgcttctgtcttcatcaacagcccatcctggcttacccgaggagctccaggccatgccggccgtgacgggcgtttgtataagactggtgacttggtctactacgacgaaggcggtgctctcagttttgtcgggcgcaaggatgcccaagtcaagattaacggccaacgtgtggaactaggtgatatagaaaaccacgtcgcgcgccatcacctgacaagacaatcagtatgtctgttccccaaatcggggccttgggccaacacgctcgtttgcatcttcagcgtccagaacaagcagcctagtcgtgaccaacttgacgccgaccttgatcgacaatcgccttctccggccaccagctcggcatcgcctgaaagcagtcttgctagtagcctgagcttcacggaggattccacgcctttggattcgccgcctagtgctgaaatggcgcttgaaaatctcacgggtgctattcgaggtcacattgaagatatggagagtatccttgagagttctctaccttcctacatggttcccacaaaatggattgccttgaaggacattcctctcaatccatccggcaagctagaccgtaagaagcttgaattgtggcttaatgaaatggagcaagagatgcatgccaagctgttcaacttagatgatctcgctatttgccaagaaccggatacgaacgcccagcgagttttaagggatgcttgtagccttgttttgaacgttccagcctatgaaatcaatcttcagcgctccttcatatcaaatggaggagattctatatcggctatgcggttgagcccatactgccgttccgaaaacgtaatcttctctgtggccactttactcaagtctaggactttggctgaggtggccaacctcgtttctactgttacagacacagagctcttccacagcacagaagagtttaacaaaccatttgccctgacaccaattcagcaatggttctttgaccaagctcccaataacctcgtcaacacgccaagttaccattgtaaccaatcgttctacgttcgcatcaaccaacaaatcgatccagaggatatccgaagtgcgcttgcaaaactcgtggacttgcattcaatgcttcgtgcccgttttcagcttcaagactctctctggatgcagactatcgctccaacggatgaaacaatataccattttgccattgtaaaactagagtcaatgacggagatgcaatctctcgctggacgtcgtcaacaacttctagacattgagcagggcctggtattctctgccgatctctgtcaacttagcgtagatgagcagtatctcattctgatagcccatcatctagtcattgacctcgtctcttggaggattattctggatgatttggaaactcttcttacaggcggaactctgccgccaagcttgccgtttcagatttggaattccctgcaacaggaggaggcaaaaacctccaggttcgacccacagcttgtcttatccacggcgggtgtctgcaatgatctgaatttctggggttttacttcagagactccaaacgcaacatgtgaccatgtcgaaaggtcattcaaaatcgataagcacaccacatcactcgtcttgaaggatgcgaattacgcctttgacactgaacctgtcgagctgctcctttcggcattgtgggacgcattcttttctacctttccatcacggaatggcctcacagttttcaatgaggggcacggccgtgagccctggagtgctgagattgatctatctcgaacggtgggctggttcaccacaatgagccccatacatatctcacgacagaacatagatagcaaccctgcgcacgttgttcgacttatcaaggatgcaaggaggaaacagcccggcaatggatgggcttacttcacttcgaggtatctgaacagcaaaggggtcgatgctttcagttcccacgattcggtaatggagatggttttcaattatcatggtcagttccagcaactagaatgtgaagattccttcttcagaagcattacacttgacaatgtatctgacgtggggccggacctccccgcctcttcgctgttcaacatcaacatgtctattgagggaggagagactcatgtctcattcgcatggaacaaacacatctgtaaacaggatcttatccaccaatgggctgatcgaattagcagttgcttacggtccttgtgcgagaccctagtatctaagcagatagagcgaacgctcatcgactttgagtttctaagtctggactacgcgggcttggaccggctgcaaagaagtgtcattcctgaaatcgagaaactaaaccgtacaagagtagtggatatctatccctgctctccaatggtggagggaatgctgctgagccaatccaaaggtgttggattttatgaaacttctcagttttatgaaattaaaccgcgtggctatcgtattatcaacgtggaccagctgtcttctgcttggcgagatgtgattgtccgccaaccatccctgaggagtattttcatcgagagtctagactcgggctccgtgcacaatcaagtcgtcctggaggagtgtgagggtgatattgtgctgctcgaaagtgacaacctgcaagctgcgcaaacgctacttcggaatcttccaaaggtgacacaccagcaactcaaaccccctcaccgtataacgctttgtaaagtcatggatacgaacagtatcttttgtcgaatggaaatgagtcacacaattacagacggtgcatctactggtattgtcattgaagaatgggccaaggcttatgccggcatcttacgcagggacaacctaattgagacgtgtcgtggttttgcgcgtgttttgaatgccaatctagcggaaagcaagaagagttattggaagaacaagttgaatggccttcagccttgtctatttccacatctacaaaagatatcgcagccttcggaagtggtttcgtggtcagttgttggcatagacggggaagatttcgcttccgtgcaaaagttttgcgagtctcactcagttacaccggccagtttattccattcagcctgggctctcacattggcatcgtatgcaggcatgcagagtgtctgtttcggctacgtcgcatcaggtagagaccttgacgttcccggaattggggaagctgttggcgcatacgcaaacatgcttgtatgtcgcgcagacatttcaccagactggactaaacaacgattcgtacagtctcttcaccatcaagtgttggaagacatggaatggcaacactgctctttggcagatattcaacatgatttgggaattgtttccgggcagcagctgttcaacactatcatgtctttccaaaaggatgccggtgatgtcggtaccgtcatcggagacttggatttcatcgacgctgacggagacgaccccacggaatacgatgtttctatcagcataacatttagtgccgaattggtgaagctgttcatcaactgtgtgccttctgggtttagcaatgagcaagcacaccgcatcgtggagttgcttagggaaacggtcctccaaatagtgaatcacgacgatcttcaacacgagcagaacttggtgcgcagcattgatagggtagccgcaaaagatctgcaaacgatttgggaatggaactcagcccttctcgaggctgcagatacatgcctccatgaactcattgctaagacggctcaaagccagcctgaatcgtgtgctgttaatgcatgggatggcaactggacatatcgcgaactgaaccgtaacgccactcagctcgctcatcatttaatcaatctgggcgttcgtcccaatactgttgttgctttgtatctcgaaaggatgcgatggacgccccttgccatgttggcagtcatgaaagctggcggagtttctgttctgctggatacatccctatccgaggattttcttgactccattatggagcagtcaaaccccgccctcttggtcgtctcgaatttgaccaaaaagctcacgcgcaagttctcgaatcatccagtgatggtcattactgacagtacactggacacattgcctaaagattctgctgcctctctacctactgttcaatcagcaagccaggcgtgccgtgtcttttccacgggcaaggctggttcgctctttagctctatccttacccatgcgaacctttcgagccttgtaaagtaccagcaaactgccttaggatacaagcccaactccagggtttacgatttcatgccatatacgtcccatataacctggagagtgtttgcccatactttcacaagtggcgcttgcctctgcattccttcggaacacgaacaggagagttcagtgactcagtcaataatccagtggcaaccgacaatgttgaacattgcggtgtcaggtgcgacttgtcttgacgaaagctgcgtccagtcactacaaaccctgatactagacggtgaacggctttccgcggacatagtcagaagatggagtccattggtagacctcaagctaacatatagcttctccgaaagctcaatgacggctactgtggccactatccgcaaggaggatgccggtaacccatgcatcggaagaggccttggtgtgaacacttggattgttgatcctcaagacggcgggaaatttgtgcccatcgggagcgtcggcgagcttgtattggaggggcctttgattagcatgtgtcatggaggtaatgctgaggatgcggcggcagctttcgttgacaatccaccatggctcaaccgtggctgtgaggatctgggccatccaggccgcacaggacaagtcttcaaaactggcgatctattccgctacaatgcagatggtacattggtcttcgttgctcgtaaagatgctatggtgaaaattcaaggccagcacgtggagccggaagaaattgagcatcacatgctgagtctatcgtcgatacgtcaagcggcttgcctgattcccaaggctgggcactatgccggcaagcttgttggtgtctttagtcttgatgggatctgcgaggcaagtagtgacattggaagtatcgctacacatctcatcccaagagacaagtctaaggatgtacaagcgtgcatcgcgtccttgcaatgtatgctggatcaatcagttcctgctttcatggtcccaactgtctgggtggctctgaaaaacatccctttgcacccttcaggcaagttgaaccgaaatctgcttgataactggctttgtacgctcgatgcggaaacacacactagaatatctagcataggctcgtcttcctgtgaaccagtaacaacagcagaaaaagttatccgagatgcatgcagccacgttctcagtatccctgtcaatcacatcaacatgcagcggtccttgatcgccaatggcggtgattctatatctgccatgcaaatcagtccacactgtcgagcatctggaatctctgtttctgtcgcctcgctgcttagaagcaagacgctcgtcggcgcagccgaatcggcaaccgattccacgggaccctctgtgtcttgtgagcaagaatttgacaagcctttcaacctctctccaatacaacagtggttcttcaagcagtgtccatctaaaaaggtaaatacaccagcttactacagtaaccaggccttttacgttcggttaaagagccaggtacggcctgacgatgtgcttaatgcggtccgcagtctcattcaccagcattcaatgctatcggcacggttctccttcgataagacgacgagttcgtgggcgcagctggttccaaattccagcgacgctgtctaccattttacatcctcacaggtggaatctctcgcaattgttgaatccattgtagctcagcgtcaccaagagcttgatatagagaaagggttggtgtttgcgacggacttgttcacccttccgtcaagtgaccagtttcttgcacttattgctcatcatttggttgtcgacttggtgtcgtggcgcatcattttggatgatttggaggtcctgctgaacggtggtagtattcataaggagctgccgttccaagcctggcagagtctacagagacaagaagttcaagcgccaagttacgcgccaaagaaagtattattcagcgaggtgcgcaacgaccttggattctggaacttcactccaagcaccccaaacacctttgacgatcacattgagcaatcattcgaggttgaccgtgagacaactgcagtcttgctcggagaagccaatagggcttttgacacagagccggttgatttgattctggcgtcagtgtggaattcattctttgacacctttaagacacgtaatggcctcaccgtcttcaacgaagggcatgggcgagaaccctggagcagtgacattgacttgtcccgtactgttggttggttcaccacaatgacaccgatgcatctatcgcgcgaagaaacgttgagtaacaatgcgagggtcatcaaagacgcacggaggcaactcccatcaaatggctgggcctacttcacctcacgctatttcaacgaagagggcattaaagcctttaactctcatgataatatcatggaagtgctattcaactaccacggccagttccagcagatcgaaactgattctttatttgagagtgtcgcatttgatagtgtttctgatgtcgggcctgagctacccgcctctgcactcttcagtatcgatgtctccatcgtagatgatcttatcaaatttagcttctcttggaaccggcatatcagtcaccaacagctcatccgagattgggtcgcccgagttgttccgtcgacgcagaccctttgcaggtccctgttggctttgaagccttcgctcacaattgcggattacgagtttctggacttggattacaagagtctggacgagttgcaaaatcgtattcttccgtccctcaagtccgagcttgccacgacttttagcgacatctatccttgctcgcccatggtcgatggcatgctgctcagtcagattcggaatcctgaaacttacatgacgtcgatcatgtatgagatacagactagccaggggcgcctcgatagggatacactgaccgaggcatggcaagccgttatcgcgcgccatccagcccttcgcagcgtttttgtcgaaggtgtcgacaagaagtcggcctttgctcagattgtgctagagaagtatcgaggagaggttgtggtgctcacaggctcaaccaagactgcagctgtagcgttgatccggcagttgcccattctcggccatgggagatcaaagccgccctgccgtcttgttctctgtgaagttgcggagaataattcaaccatctgccagatcgagatgagccacgccattgtcgatggagcatctacagccatcatgttgagtgactggtccaaggcttacagcggactgctaagcgcagaagtgctaaatggaccaaatcgcagtttagcccaggctctcaagactatcgctgtggacaacaaaatgacatactggaagaacaagctcgcggaagtagagccctgccactttcctcgcttgtctgaatcgtcttttaccggcactaggacagtcagtgtcgacctgggcggagacgactttgcacgaatccaacacttctgtgaagtccattccgttactccggcgagcatattccagagcgcctgggcgctgctcctatctagttacactggcagcaatgctgtatgcttcggatatattgcatcgggccgcgatctacaggttgatgggatcggggattctgtcaatgctttcgccaatatgatggtttgttgtgccaatatatcgcgttcttggacaccagatcagctcgtccaggggcttcatgagcaattcttggaagacttggattatcagcactgttctctcgctggtatacagcacgaactcgagcttgcgcccaatatttctttattcaataccattgtttcctttcaaaaggatgatttcgagacgcaggaaagtatcaatatcggagggttggtgtttattgatatggattacgaagatcctactgaggtaagtctgtttcatgcttgagaaaacgtatttccacaattttgacaattggtttgcttcgcagtacgatatttcttttgatatcagttatggcaagaaggaggcatcattttcaatagactatcgacaatcctgtttaacagacaaacaagctgagcgtgccatttcgctcttgaggctcattgtcgcatcgctcgttgatgaagaggcattgcttggcaccatcgccgatattaacatggtcgaccgggatgatcttgagcagatttggaattggaactctatcgttcctgagacagtggagtccttgacacatgatgtgatatccgagacggcacttaagtttccctccaccttggccatctgcgcttgggatggagattggacatatcagcagctagatagcctgtctactacacttgctcatgaattggctcgtcttggtgtcggtcctgaaatgatagttccgctctgctttgaaaagtctcgctgggtaccagtggcgatgcttgccgtgatgaaggctggtggcgcgagcgtggttttggactctactcttcctcaagaacgcttacgagttattctgcaacaagtctcaccagttatcatcctcagctcgtctgctagccaggatatcatcagacccttaagccaagagcctatctttgtggtcgaagagacgaatgtagcccgcttggaagcgccacttgatgcaagaacagccatttctggtgtgatgccctccaacacgctttatgttgtcttcacttctggaagtaccggaaccccaaaaggagtggctattagtcactcgaatttcgccagtgccctccgtcatcaagatggcatgtacaacttcaaggctggctcccgagtctatgactttgcgtcttacacgttcgaccagtgttggtccaatgtgctaaccgctcttgcgagcggggccactctctgcattccatcaaatgctgaacgccagagtgatctggctggatcactagagagatttcaggtcactcacgtggacatgaccgcttcagccgcccagcttcttccgcctagtatattaaagcgtttggacacattgatcctcggtggcgagcctctttcacccgaattggccagatattggtctagtatggtggaaaatgtccagaactgttatggaccgtgtgaatgtacgcctaccaccacatcggcaaatattcactccggaaacgttgaagcggtcagcattggccgcggacttggcgtgaacacgtgggttgtgagtactgcaggagactctcttgcaccgctcggaagcactggtgagttgttcctcgaaggtccactagttggtcctggttatctaaatgatgcggagagaaccgctacttctttcatcgaggaccctccttggctactccaaggctccgcgacccatgccggacgccacggacgcctatacaaaactggagatcttgttcgctatctgccagacgggagtttgacctttctaggccgaaaagacagtcaggtcaagataaacggtcaacgtttggaactcggtgatattgagtactacgtccgatccagtatcacctgcagttataatgttcaagtagttgtggatgtggtgaagcctcaagacagcgagaagcagatgattgtcgctttcttggccgttgagagggaggtgtgtccaagcttagacgagatcacagctggtcttctggacaggctcggggccaaggtacctgcatacatgatacccactgcttacatgttacttggaagtataccaatgacaccttcgggcaaaacggatcgacgctcgctccgcgccatggctgggaaactcaaaagaatcgatcttatggcccatggtccgacgcagggaaaaagaaggaaaccaacaacatctcgagagattcagctccaaggtctctggtcctctgtcctcggactacctcgcgaatctatcagcagcgatgatagcttcttgcgccttgggggggattctgttggtgccatgaaacttgctggtctgtcgcgtggctgtgggctttcagtgacggtgactgacatattcaaacatccacgccttgctgatcttgctaaaaccgttcgaagctcagccaacagtcaacctgaaatctccgcaccgttctcgttgctgcatggagatcagattccatccgagattcgggctcggatttctcagctctgcaacgttgatgctgcaaacgttgaagacgcatttccctgcacacccttacaggaaggcctgatggctctgactttgagacgaccaggagactatattgcccaaaacatctttcaacttcaatctagcattgatatcactctcttccagcaggcttgggagcatgttctggaaacaacgcctattctgcgaacccgtattgtcgatattggtctccaaggtttgactcaagcaattgtttcagacgaatcgattgcttggccaagaatcaccgataccattatctaccaggaaaatgacacgcagctaggcatgggcttgggctcacctctcatgcgatatgccataaccagaagctcaaatggccgatactctttcatctggactgtacaccacgccttgtatgacggctggtccatgccaattgttcttgagagacttgagatggcatacaatggaacggtcctgcaaataccacccccattccaaaactttgtcaaattcattggccaaggtgatgagaaagttactgatgagttttggacatcacaatttgaacagatccaggctcaatcattcccatcactaccctcgcccgtctaccagcctcggtcggacagtggagttttgtaccacatcaaagacatagtgtggccaaaaacggagacgacggcatcgaccgctatacgtgcggccctttccatcctgatcgcagcctactctgatgattcacatgccctctttggtgcgactgtcactggtcgccaagcgccagtcccaggggtcgagagcatgacaggcccaactattgctacagtaccgatcagggtagccctcgataaggcaaggactgtgaaccaatttctgcagcaaatccaggaccaggttgtcgatatgacagcatttgaacaaactggtctacagaaaatccaaaaggtcaacgattttgccagacaggcctgtgagtttcaaacactgctgctcatccacccatttgagcagccaaacaagtccacgagtcctcttttccttgacacagatgatgaagtcgtaaaagatggccttgtggatggagacgaggccgatgatgattctttttccaactttgatacacatgccatcacgattgagtgtgatcttgagccgactggcgcgttgcttcgcgttaggttcgactctcaggtgatcaaaaaggtccaggtgaagagactcgcggcgcagtttgacgtgattctacgtcagctgtgcgacccagacttgggacagtgcaaacttgtcgatatcaataccgtcagtaccagggacttggaacagatttggcaatggaacgcagtcgtacctgagactatcaactacactgtgcacgacttaattgccgagaacgcttctaagcgtcctgattcaccggcagtctgcgcgtgggatggccattggacatatcaagaaatggagtcaattgcaactcatatcgcccatcgacttgtgacgctaggcgttggtcctggtgttatcgtacctctttgctttgaaaagtctcgctggatgcctgtagcgatgcttgctgttatgaaagcaggaggcgcttccgtggctttagacaccacattgcctcaagaccggctccgcactatcttgcagcaagttgatccgcttttgattctgtcctcgtcgtcaagtcagaagctggcgaagcagttgacgagccaaaccatggtagtcttgggcgacgacgacgaaaaagacctttacaaacaccctttgcacaaaacactccctaaagtcgagccatggaacaatctctatctcgtctttacgtcgggaagcactggcgttccaaaaggtgcaatagttactcattccaactttatgagcgctattcaccatcagcaagctattacaggtttcaatagatcatcgcgtgtatatgaccttgcaaagtatgcttttgatattacctggtccaatttcgtacatacattggctgctggcggctgcctttgtattccttcgcaggaagaggctattggcgacattcctggctcagtccgggcgtatgacgccaatttcatagacattacaccatctgtggcaagcacactacggccgtcggacttgagcagcctgaaaaccgttgtatttgccggggaggcgctttccaatcaccaggcttcacaatggtcaaagcatgcacgtgtgctcaacatgtacggtccggcagaatgcacagtcaaggctacagtggctgaggttgacggatgtggctcatcttcagcggctagcatcggccgtggtgttggtctgtgtacttgggttgtcaacccttcagaccccttcaaactggccccaataggtacagtgggcgagttggtgctggaaggaccgcttgttggatccggatatctcaatgactccgtaaagactgcagaggcttttattcataatccaccctggctgctccgcggtggacctacccaccaaggccgcagtgggcgtgtatacaggactggtgatcttgttcagtatgatattgacgggagcctcacatttatcggtcggaaagacggccagatcaagatcaacggccaacgattggaactcggcgatgttgaatacaatctcgcagcaagcctagggaccgagatcaaagtccagcttgccgctgaaatagtgatctccagggacggtgacaagccgatattggctgccttcatacaatcatctgggcagtttcaagattacaattcagaagtgcaggcattaacgaagggagtcaatgaccgccttgcctccaaggtccctagacacatgattccgtcggcctatatcatggtcgataagctaccgctctctgcgaccggcaagttggaccgcaagcaactccgatcattgggggcaaccatgacactgtcggagatgacaggttcggcacaatcgcaggaagaacgccggccgccatcgacagaggcagagctatatatgcagagagtttgggctcgcacactcggtgttgacgccgattcaattagtgctgacgatggttttctccaacttggaggtgactccattctcgctatgaagctcaccactcaggcccgaagcgaaggcttcgagctctctgttgccgacatactcaacagtccgaaactgtcacacatggccctgcatctacgaaatgggaacgatgagtctgccgtttctgcaccgagttaccaacgatattcccttttactaccagagagccggccggaaattgagcagatcttgtttgatctcggtgtatcaacagacagtgtggaggacattcttcctgttactgaccaacaggcccgctatcttctaacaagttacacatcggctcgtagctccgtgtactaccatacacgcgattttccccatgatttcgatcttgatgaaattcaacaggcctgcttccgacttgtcagacgtcttgatatgctgagaacggtctttttcgcgtacaagaatgagttcctgcaggctgtgctcacacagacagctggagaaattgacatctttcggaccgcagtagagagtttggacgactttacgttgaacctgaagaagcaagacttggtgtacaaaatggagtttggaaagacacccaccaagattcgcatcattcaccaaacgcgtgagcaaaaggcccgcgttgtgattcgtctttctcatgcccagtatgacggaacagcactgaccaaattgtggtccgctttcgaagagtgctatagctcagcctcgagtagtgatgtggacacggggtcgagtttctctcatcatctgcataccctgtccctggtcgataaacaaagcgcagcagaacattggcgagacatgctgcaaggaagcacgcggacacccatcaaaagccagatggcgccccgtctcggctacgggcttggtccaacggttgtcaagactataccagcatgcaatttgcagtctgaagactttacctttgctaccgtcctgaaggctgcatggtcatatgtcctcgcaaaacactcggcaactgccgacgttgtttttggcaccctggtacacggccgcaatctgccaggcacgcaagacgttttcggtccctgcgttaatatcgtcccttgtcgcctcatcttccaagaaaactggacggcccgggatctcatttccgccatcaactctcagcagttggccagcatgccgtacgagacaataggctcccgagacatcatccgcaactgcacgagttggcccaagtgggcctatttcagttcggtcattgtgcatcagaattatgagaatcaccaggcggaggaccccattaaagatttcgatcattccgacctttcgacgggtgatatcgacagtgtcgaggtctacatcacgtccacgccaggcccggaaagcacagaaatcgaccttacctttgcccacaataccgtttctccttgtctagcagatcagctcgcttcggatctgactcgcaccgtcactgagttctaccaagacttggacacgagattgatggcaccaggcgacattgagaatcagccggccttgctgcctgtggcaggtgatgcaaggacaaatgtagctcctccaactagcgagcaaataatgatgctggagagctgcccgagcaagttaagagatgatctcggcaacgcttggaaagacgtgcttagacaccatgatgtgcctggtgatctgtcctgcgaaaccttttttgagctgggtggtgatgcccacaatgcgggccagctagccgctcatatgcaacggcaaggctaccagcttaggattgagaatgtctttgagcatccgacatggtttgacctcctgcttgagactatgaaacagcagtaaatggggatgtcatcacgaacaagaaggggaagtttttgggttttggaagggatttggagagcagaaggatggatgagtcagcccaagcaagcctaccctggatcctatgaagggtcaaaattcgcaagtaaaggagcgtttttgtatagcactcactcggcagtttttggcgagattttcaattcctttgcatagattagcatgggtttaagggttgtcttatctagactttagcttttgaaattattttcgtttcggtcggagttactgatttgtacttcaggatggttggatatggtggatcatcacgtcttaatacaccaacgttcgatcaaagttgctggtcagaaacatatctccaagtcactcacgtccccccgctacctagcgtaggtatctattaactaatactgactcggttcgattgttttatatgcctttgagaacagaagtatgaaaggttgggcgcaaggctagtaagctgagagaaggtcgtcgggcaccacatcagccagagcccaccaatataacccgaatagcatcagccgctcatatctacgaccatacctgcgagacagcactggatcccgtctgctctccgtacgttaagctcgcaaggggccgattagtagctgggtcggtgacgaccagcgaatcccggctgttgtaggttttcatttttgcctcttttttgttgcctcttccttgttcttgtttttgattgggctacttgtcgaacattgctagaaaatgcaccggtatctggcgacgtttgatgtgcgtggtctcggaacattacgagtgttttgacccaccgtgtggcaggagcttatggagacacgagcatagcaaatattcaaggcaatttggtccatgtgactgattgatcagattaaaaaaaaaaaaagaactgtattgtggtatatataaaacaacaatcttagaaagcacagagtgtgctgttgtatgaaagacaatgcttcaaatctagttatgctcatcatgattccaccaacgccggatatccctatcaatcaatacactcctatacatgcaaattggtcgtttatcaactttcccccattttgaatttcgtcgtcaacttttagttgggggtgatgttacgggcagcgatggtgccgtcgaagcttcccagccctccaacctgggctccgccttcagagcggataggagagggctggtggtgtgggggaatgtcctggacaatgctgctgagaacctcctccttggtcacattgagcttctcctcaggaagacccatggacttgaagaagtgaacagtctgggtccactcaagctgcttgcgggcctcggtccagttgagctcctcggccatgatatcaatgacacggggaagagccttgagggcaaccccgacgtcaaggaaagccatgcgagtacggcgtgagatcaaatcagcagcagtgcaggctgactcggagcgaacaccgtgacggaattcggcctcgatgaagggaagggtgggaacaactcgagaggtggcgttggtagcgagaacagcccaagcacggtcgccatagttgatcgcaaggtgctcagcgacatcagcgtcgacagagtggactgacatgagctgggaggcgagttcaggtgagtatccgtgggcaccgatgaggggagtagtaagagtgcagcatttgccagtagtggagaaacctgggagaccggtaccgctgatgtcggggagaggaatagagctgggcttgaggttgaatgttttgacggcttcatcgacagcatcctcggccatttgacggtaggtggtccacttgccaccggcgcatgtgaggagaccagagggggagacagtgacgagatggctgcggacgagagactcggtgttcttggccttgggatccctgacaaggggacggatacctggttttaaagttagttgatacccttggtagatttcactggggagagtcacataccggaccagctcgcaaggacatcattgcgtgtgacagcggcttcggggaggagcaatttattgacctcagtcagaatgaagtcaacgtccttctgaagagcaacaggctctctctcaacttcacaggcattatcggtggtaccagcgagggtctttccctgccaaggcagaacgaagacaacacggccgtcagaagtagaagcttcaagcagaccctttccattggggcagatacgaccggggagaataacatgtgcaccagcggcaggggaaactagaggctttcggctgccgtcatccatatgctcaatggcgtctgcgaagggtccagtggcgttgataacacccttggcacggatttggaattcttgagcgccgtctgcgtccttgtccagggaagagagaacatccttacccttgacacctgtaatcttgccgttggcatccttctcgaggctggttacctcgaaatggttgagcacagtagcaccgtaaagagaagcagtcaaagcaagggagacgttcattcgagagtcgttgtgctggccgtcgtagtaaatcagagcgccaaccatgttgtttctgcggaggagtgggaattcagcccaggccttgctcttggtcatgaagtaggagccctcgaggccctgggaaccggcaaggagatcataggccttggtgccgcaccacatgtaaggtgcctgccaccactgctgaagggggaggagaatagggaccgagttagacaagtgaggggcaatgttgaggaaagtcctgcgctcgcggagtgcttcaataacgagctcgagctgggggtaatcgaggttcatgacggccttctcgaggtagcgcacgcctccatggacgagcttggtgctcttggagctggtacccgaagaaaagtcgtcgcgctcaacaagagcaaccttcaagccacgagtggcggcgtcgacggcgataccagtaccggtagcaccaccgccaataatcagaaggtcgtactcggcatcgctggaagagccatcgtggcgtcgaaggtcgtcgagctgctccttgcggcttttgagagctgggaaggtggggggtacgattcggccttggctgtcgcgcttggcctcaacaatgggcatggaaatggtgtgcttgcgggagttggcgtaagcgtaaagcccagttcctcccactgctgcagttgcagcagcgatagtgagggggcgccttagagactgtatgcgtgaggccatggtgaagtctgctgttgttgccgacgagggaagccttccggcaaagggctccttgtaaggggtttcttcttgtcctgggggctctgcgggtatggaccgtgagagcttggggtatgggtatggcaggtattaagaaacaaagaatgaagatgccagtcaagtctatgctgtggtaggacaagacttcaagatgagccgttttcttaagagtttgatccaactttcattcgtggaaagacatgatccgcaaacactgggatcggcacaaaagcccgaagtcgctgaaagaagaaaaactcccatcgtcatctgtcattctcacttctcttctccgttgttcccgtgggggggcaccccctaaggacagcggccgggtccacgtcggcgaggctcgcatcttgatgggtttccgtggagcacgtgcggagaccaggactgccgtgtggactcaagagtgggcaccgcggctgagctgacaaggttttgcaggtgctctgccagccggccaggcacaggaatggacggatgtggtgtttcaattcgacgacacgagctgggcgtttcgtgcattttgcggctcactgcgtcatggcaagtcatggcaggcgccatcggacggcccctgccatcacgcatgggcccgcttatgcatgtcggtgtgctggttccgagatttagctcgggaagtgctcggggtcgcgacccgaccactttaaattttgggtgtctcggggcacgcaccccgagctgccaaccgggaatttctctcactcaccgcggcgagggaagatgaggcctcattgagctatgagctatatacatacctggcacactcggctgcgctctcatcaacggcctggatcccggcggaccgtcaaccatctgcgctggcaaccccagagtgttgaccccatatactatgtgagagatatcttccccgtgggctggatctataattgcgtgcattctcaaggtaccctatttttaaactcgagacactaccaccagatttccccaagtcccgggtaatcagtgtccctcacttagatgagataacgttagatggtgtaacgggggatctggtaggcgggatcagggggacacaaactcaaccctccactttccaacccgaatcccacccttgcagattgcagcagctgtgacatgccatcaatcagtattttagctctccctttgggagactaccgtttatgctgagcgcatagagtgtgttaggatacccgtcaacgttagccctacgctgtgattggtggggaatcggcctcacaagcctgcctcatttgctgaacggaaaagaccaatttcagccgaaggggggccaagggacgcatcccacgcaacactaccactgactgtagtgtggtagcattcatcaacgtgcttcgtctcatctcgggacgagggtatctgatttagcgagctggaattcaagggcaagatgtatcgcttacgcgaccacgcctcctgccctgagctgagtcttatccatgcaggtccaaggtagtggcacctgctctcacggagaatctttttccgcctaggaaatcgcagctatagactgctctttccagctagcgcagtgcctagaacctgctccgattgcaatattgtaaggcagaccctgagcaagacaaggtcaatcactgtccggaccccattttacctcgtgcgtgggggagggtcggtccaatccattgggcctccagcggagaaaacggtctggggcatcgggcatcattggcctctttccggcgctgaagctactcaaaaagtgaggcgacctagacgaggcgagaaaaaggaaagcctgcctccttctgctggtttttcctcctggacttaggaagcttgtctctttgttttttcaaaagtcatggcattgatgttttcttcctatctttctgctcttctcattcaaccctcaacgcttttttttctcgctataccataaaatcattgaccccacgcccatcgaattgaattgcagaaaaacagtcagtgataattcaactcggccccgctcctccaatacgccatccaaaagtggacgaacattgcctacaatcaacaccaaaacatgaacaattgaaatacagaatacacagcgcagcagaaacaacaatagcaacaacttgtagagtacaaggcccacaactcagcagccatcaccaccatcgtcaagcgtcgtgaatccataacgattaaaaagcattaacaaaacatcttcaaccatccagtgagtcggcggtttctctgtacttagttgtcgcaacgcggggctggcacctgcgtttggccgctacccatcatgtatgggagatggtcctcatcttctttctcttcacatcctcaaaacgctgtcccctctatcctcacttgatcccataccactgaaagagaatcctggttgttactctgtcctcgaatctcggcaatctcctttcgagggaacgggtcgtttgtcacggcgtcattgtctataccgacgagatctgcttggccttgtatgtgttggaccagacattgcgtctgggctgcagcagtctcttgaatccccaccaaggggtgttgacggggctgtccttgccggtgtacatgaagatgtcgtacaggaaggcaccgaatgcagtgccgaagaagggagcaaccatgggaatctaaagcatcactatcattagccattggctctttcaactatcgcaaccgcctttaggtctctctctctcgccatatacaagagagaaacaggagcgctgtggatggaagaggcagacttacccagaagtaatatccaccagcagaccagacatcatggccgtagccgacaatgtatgaaaccaggcgagggccaaagtcacgagccaggttgattgcataaccggtctgccatccgaagcaggcgccaattccaaaaatcaggaagaagagtccaaggggcatgagtttccgggcatttccattcttggggtcggccatggcaaagatcacaaacatcaggatggtgctggagacaacctcggaccaccacatctgcgtgcgggtcaggaatgcggcggggtaagtgcagaagatgccagcggtgctggtcgtgccgcctacagtgcgcacgcccggtccctccatgttatcaatggcctggtagtatgttccgtatacgatgaaggctccggccatggcgccgaggagctgtccgagggcatagacggggagttttcgccaagggtgtccgcggaagaggcagttgcagaaagtgacggccgggttgagatggccaccagacttggagctacagtagacacccaacatgacagccaatctgcatgaggaattctcagtcagtcatcaaagatcatctcgaaacccaaaatcacgttcgccaaacaacagtcaacaccatcaacacaccatctcttctcatcatcacactcctccttttacattttctgttcatgctgtttcggtatgaagcgaacgatccggaacgaagaaaagttggacttacccccagccccaagagatactctgatagtcacccttcttctgctcactcagagacacttgggcaacaacaccatcaccaaagaggatcataacacaggtgccgaagaactcagagaagaagtcctggcagtactcccggatcccaatccatgccggctcatcctcagccgggtgggagagctcagagtgagaaacctcctcctgcgacatggagccggcgtgttcaatcttgtccactggaatgatggtcttatcgatgaaggaaggaccaaccgagtcctgagagtgagtgatggacatctggtgctaggggggaaaaggtatgatggaataattgaggcgacaacgaacaccgataacgatccaggacagagaatcggtcgggatgcagactctcgactacaagggaaagggaggggcgacacggtccttatgaactttgagtccccacggggattggagtctttcttacggaaccgttaggatgggaacgttagacttggagaagatgatgagtctagattcttggtgtctgggggggccttgttggatgaggggtttgacgtccctggccgactggctgacttggggaccggaggcgggtgaacgggtgcgtgacgatgcagaggctgcaggcaatggagacgataatcttgccagagtgccttcctcgcctctgtctctcctcttccgtgtgggcagtgggcaatggctcagccaggatggggttggtagtgcccgggcatgtaccatgtgtggatcccctaatcagttcgagcaggatgccggatactcatcaatggttcattgatgaggacgggtgggcagtttaccacttctggtctagatgggaagcaggttcgttgcagagtaccgaggaatccatgtcgcaagcaccgagagaagcccgtgtcctggtgtcacgagggggtagtacgggtacgattgagcactgtccccttcccatcaagggctctagcgaaagcttcgatgcaggctcggtggcggcgacccgaaacctgctacaaacactggcaacaacgggttgaactgaagcctagggtgggaccggaaatggcaaaggatcctctcgggaccttcagaaccggcggagcctgcctgctagcgtcgacaataatgcagcctctctacctgagtttacggagtacggattcctacgagtgggctcatcttacttccagacccgctggcgacgtccgaggctcgttttacctattttttgtttgctgtgccagacagacctgaattccctcgccgttccgtccaagactccaaacccacaatcacaagcgcaagtgcaaggacggaggcaacagggtctgccaattacacaggggggaggggggtcagaaaactcactaaggaaggagaggggttgacaatggatggatggctgtgatgatctttgctccagccagccagccaagtccgttgccttctcctcctggcagtcaatgacagaggccaacccccctccccccgcccccgtcagctgcatgtaacgtcaaataagaaatgtcacatctgcagccgaaaactttgccatcaagaatgggcactaaaagtaggctgaagctttttactttttgacagtgccggcgcctctggatgcaattggccggctcaggcctcggattgacaggagagaaaatctctgacgtgagtgagtgggtgccctcgccttctccagaattactaaatcttttctggaacgatggaagcttgtggggcgcgaccggaacaagtcgaattgagaggctgaaaagtctccgctgctccctctttctagcctttctagccggattctctgtcatcttacgcgctacagacaggcttcatgtataacacatctagatatggcctagtccagcacgagtcgggccattccaacatgtattcgcgggggcatccacatgcctgacagcaggctgtgaccccgtgttaccttcaccgagtcagggcctttcgcatcttctcacctaatctcccgccatcatctgaccaagtttacgtgcatctcgacagggggaggctttttttttttgtcgacatcgtggaaccgagccatcgcctcatagttcctcaactatgggacaagggctgatgcgccggccgtgatcctactgccatgccactgtcgcgcgttcaacggatccggccgcggctattcctctcgaccactagcgtcgtacgtctgtgggcggcgcgagaaccctgaaccttgaaccataccatagtctgtcttagacgaccagaccgttcgcgtttgcggttcaatggttggatgcatccttcatcacgtcgtagcgaagggttgcagggcagcggctatgtgcgagaatgaggggaaagacagggcctctgattggatcgcccgaaagaggaggagagctactgtgtcaggacggcacattacgtagggacgtgtgctgagggtggcgttggcttgtagaggactggtcatgacgacactgccttggctgtggccaaggattgattcaagacatgccctctagcaggcagacagggcggctctaagatagaaccgacggaagcctcggaagatatgctctgcttggtattgatctttggtgctcagctcgtaacggcctaggcagaggcggaaccagtgtcaagtgaccactggggccgagccactgcaccggggccggccgtccctgacgccctggtttgtttctgactgtggataaggcctcttgaaggatgatcgtagaaagagactgccgaccctcaccgagctgtgcgggttcagcctcctaaacgggtctctcggccgtgtgggcacatgcacatcggcgcgctcccgagtaactcgggctctaaaacccgactggaccgaatggcccccccactgtgatctccagaactcagacagctcttgatctcgtaccaagatctgagctcccatggcctcatctcgaggccagctgaatctcctccaggtcccaaataagcggttccccctgcccagcccagacacgctgtggagagcctaccagtcactctggggtcgacccctgcatcccatgacctgagaaaatgagagaaaaaaccgagaatggggacctgggttggaattattccctcgtgctcgttctccacactcttttgttcgccgcgggggtcccacgacggggaagctcacgttctccgaacggcggtgcctgggcttggatggagtagatgaggggttgagctcgaccggctccggaagcagtaagtccctaccaattgatgcgcgtgtgtcttgtgtcttgctcgcctaggagctaccccatggaggccctgcaggagttggatggaccagcagcgccagaatacaaataattttgccgttccccgacatgtgatgcaacctctgtgtccctccccctccatccttctgacctcgactcttgcgctcgtgctcgtccggacaatcatttcaacggccctcgctgcacttttttttccctctcttctctcttccttctcatctcgtatcttgcttcttgcttgacctcttgcgcgtgaattgataccccaattggcaatcgcatctgcatgttccggtccttgctcccaagtagatccaagacgcgccagacctctcccttctcccccacaaacaccaccaccatgtccccagtcgctcagcctgtgaacccaacttttgttggcgccattgaccagggcaccaccagcactcgcttcatcatcttcaacaaccgtggtgaggttgttgcggtgcaccagattgagttcgagcagatctaccccaaccccgggtgagtgcccctccattttgcgcaaatgcgcaatcttatcttctacgcgacaaaggccaaaaagagaagaaaaaaattgaattatagctaatcaatctcaattagatggcacgagcacaaccccgaggagcttgtttcctccgtagagcagtgcattgacggcgccgtcgaggctttcgagaagcagggccactcgcgcgaccagatcaaggccgttggcatcaccaaccagcgagagaccaccgtcgtctgggacaagaccaccggcaaggccctgcacaatgccattgtctggaccgacacccgaagccaggacctcgtccgcaagctcaagcaccgccttggttccaaggagctgactgagcgctgcggcctccccctctctacatacccctccgccagcaagctgctctggctgcttgagaacgtccccgaggtcaaggctgcctacgacaatggtgtccttgcctttggaacggtcgacacctggctgacctacaagctgaacggtgccaccgctcgcgagatctacgtctccgacccctccaatgcctctcgtacgatgttcatgaaccttcagaccctcgactacgatgacgagctcgttgattggttccgccttgacagggagaagatcaagctccccaagattgtcagatcttcggaccccgaggcctacggatccctcgccagcacctctctgaagggtatcaagatcaccggctgtctgggtgaccagtccgctgctctggtcggccagaagggcttcacccccggccaggccaagaacacatacggcaccggatgcttcttgctttacaatgttggtgacaagcccgtcatctccacccacggcctcctgtccactgtcgccttcgactttggccccggcaagaggatgtacgccctcgagggcagcatcgccgtcgccggctccagcgtcaagttcctagtcgacaacctgggcttcatcgagtcctcctccaagcttagcgcccttgccgagactgtcgaggataacggcggtgttactttcgtcactgcgttcagcggtctgttcgccccgtactggatcgatgatgctcgtggtactctcttcggtattactgcctacacccagcgcggccacatcgcccgcgccaccctcgaggccacctgcttccagaccaaggccatcctggactccatggccaaggatagcggcaagtctctcgcggagcttgctgtcgatggtggcatgtgcaactctgatctcattatgcaggtaagtactagtgtggttttttggattgccccctacctaaagcctcccaaactcgtatgggggctaatgaaattcttggcgtgcggttactaatgacgttttggtacacagacccaatctgaccttattggcattcctgtcaaccggccggcaatgcgcgagacaaccgctctgggtgctgccatcgcagccggcctggccgtcggagtctggagcgacttcaaggagctggacgacgtcaacatcgacggccgaacgctgttcaagccccagatcgacgctgcgtccgccgacaagcaattcgagcgatgggagaaggcagtccagatgagcaagggctgggccaactagaaggggggggaatatgaatgattgatgtttttgggtgccggccgggtcggagagggcctcccaaatatgtatgatactacttttaagggcgtcggagcgaattggattacacgtttttgtttctggatatctcattgataagttcgccagcaatgaatggtgcctctgggcgtgcctgctcctgccgtgttatcatttgtggagatgagctcgacaggtttcggtggtcaaagtccgagatgtgaggagctgggcgtgatcatggtggtgatggcgaagcacactccgttgcatcccctgcaggtacatgtccaatgcatagacgtagatggtttcgtacatggagtctctcgcgtcgctgttcgcgagcacaccggcgtgtaccttcaactacacatgggagcagggatctgtctgggtgggttgtcatgtgctgtgcggttccggatacactgtgcagggggaggtgacgttgcgatcaattttcgcccctgggagttatacacgactcgtgggattgcccgacatagctgacggtgtagaagttggaaccttagatcacggcttgccgcggtaagagctttgacctttggccattgtatcatgacccctaccctacatgtgaggagtaagtaggtagcccttgccttgatgcagatacattgccgaaagtctcttttgtaaggttgatgcgttctttccgctgtccacggcgatcgccgtgtgtgtccgtagaagaaattttatgccgtcacaatagaggctcttgccaccaccaaatgcgctgcgacgaactgtgtacaggcagtgcagtacctacattgcctgtggaggggctgattaagctcaaacagatgccgggcaagttcccccaacccacagccacagcgcaaggcaacctaaggcaggtaggtaccttctcggtactgtgctgtcccttgctcctgctcctcgggaggaagcaccgagaaaagcccgctgcgacggacgagaagcgcactagctgctcactggaacagccaaccaacggtttagcatcgcccgttagggaacaactcccagggtccaggcgctgagcttacaaggcgcccagcctccaaccagaccacctcgtggtgcggaaacgcctgtgggtcggttgatgacatttccctgcgtccattccaggtcagtcgaaaagcacctgcatacgattcgagcaagagcccggacaaggccaaccgacgggaagcgaggcagacatgtcccagtgttgatcacccatcctgctctcagccggtataaccaatcctgccgggactcctcatattcgggagtgcaggaccggctccctccctcctcttatcagctggacaaagaaaaccagaagcccggaattacgggccattcgactctcgcatgttgatagtggcatggcccatatgtgacggatgccgattgcagtagcacaatgaccagatccaatgcacctgcggccgaggaggacgcgaactcgggcatcagctacgaggagggatcaagtggtgatgatacggcccacaatgtcccttcggccacgacaccgaggaagcgaaagagagagaagcaccagaagacctcgtaggatcccactcttggaccctccccctgagtccccaggatgctccgttatcctcttgatcttgctgatgctgaccactttaatatagatgtgagttgtgcaaagctcgcaaggtcaagtgtgaccgtgctgagcccgcatgctcgtggtgtgcccgtcacaacaggacatgtgtctatctggagagacagaagcctggaagccgcattggcttcgggctggagcttgaggccaaggtcaacaagatcgacgccctcttgcagtctcttggacggaggttggaggagcacatagactcccatgatgccccatcacccgccatcagcacacaggcgacgggatcacaggctgatgtagcccctcgaggtggtttctccaatggtgtgcccgtctccggcactcctgcgggcggcactccgaactcccaaggaaccgcgagcctcttcccaggtggtttctggcctggcagcgacgcccctgacgttgcccagtatggcgcccagcagaacccgtctggggccgtccataacaccagcgcgccgcctttgtcgctgaacccttcagtttcatttcgccagccgccgcttgctacgcctgctctcgccgatctgccgccccaggatgtgatatatactcttgtcgacctgtactttaaacactgcaacacatggtgccctatcctcgagcgaaaaacaacattcggaatattcttcggttcgacgtcgatgaacgaagcggaccgcgtcctccttcacgccatagtagcaactacgctgagattcttgaaagaccctaggttatcgtacgaggcgaagttgcattaccatggtgtttcgaggaggactgttcagctctatgcaatggagaatgttagtatcgaggcattaaaggtatctgttattctttctttagacgaactcggtactttgaatggcccaagaggatggaatctgctggccatgctggcccagaacgccaggcagttaggcctttgtgaagagacgagcgtatttttagcgaccgagcctgacgagatgccgaccactggatcgatccggcggatagctacaaccagacccgagtcgtggatagaagatgaaggaaggagacgcctatgttggatggtttatctcctggacagatacgctactattgctacgaccacgttcgacttctccttgagcgacgacctaatgaagcgagtccttccatgctcgtacgacttgttttctaggaacgtccctgtcgagacgcagacggtaatggcatcgaatgaccagcaacctaaccaggaaacatcctttgtggtgaagaaacccgagaacttgggcagttttgcctaccactgcgagatcctccgtatcatcagcaaaatccacaacttcttacgaacgccggttgatgtgacatcttccacggacatggccaactggcgcaacacataccatacactggactcctcgctggattcttggttgcagagcttgccaagcgaatacagcaagatatcggctttgtgccattcggacccagctagtcgcgttgccaactggtttatgctccatagcgcgtatgtggttgcggttgtacgacttcattcagcagcagcgtatcccacggtccgatcacacatattcgttccatcacactatgcaatgcaaagatgtctctcggcggttcaaagcctcggcgatattgctagagatgtctacgaggcagatgggttggacctactgggcccgcccttcgccttctctctctgggttgccgccagattgctgattgtacacgcagcaacagttggtggccctgtcgatcccaagatcgaattcctggttgagacgctcaaacacgttggccagtactgggaggtggcacataactatgccaaggtgttgagcagagtgatccagcgagctcgccagaataatatgagttttgccgctatgagaaagtaggtgcaaaccctcaaggttttcattcttttgtatacgttctaacagttttccctttgtaggagcgcccatgacttggtccagttgacgacgcagacgagacgatcgggactggaaagcacgtcaacccaaaacacatccttgagcgagctggataatatagacgttttcgacttcttcaacttacccagagtttcaaactcaactatcggatcgactgataaccagacaaatctgctgttacctcaaggaacttcaaacgtcaacaacagcggaggtgttccagaccccgaatcggattggttgagatataacgcaacatatcattgacggtactgttatccacgaaggtaatctgtataaactataaacacgacaaccattagggtatcggtaatgccctgccaaggccagttgataccttggctttgggaaacaggaggtccctcatcctaggtataccaaaagagaggcttctaacctgaggatggttttcgccgccacgagcacctgtgaagttgggcagatcatgacaagctgaagctaaacttattaagaggccatttatcaaattggtgctgtctaagcatggcaataatgagaggtatgcgagcgtggtggctgggcattagatccaaggtctatgttacggggaagcggcgaagagaggaacctgagatgcagcacaaaaattgggcttcctatactggtcgccatttccaccatggaaacaatccatacatcgagcttgccatggcactctgttatgaaccttatgtgaagtatcacatgcgaaccgacctaggcctcccttgccatcccggctttactggtttctacgagggaagcaagaagcttgctaggggtaaggtcgaccttccctaactctccgctctgacgtcttgaaccatcgatttcactttccttcgcctcgcataaacaaggtagcttaattttaaaccgatacgatcgtatatcgctgaaatacaatccacgatctttcaaccgcacagcgccaattattcttccatctaatcagatatcggagcggcatcattatctcaaaagttcattccttcaagagatgcgaactcaactcgtcgcagttctcataattctcatcctccttccgtggttgttgcagcccccttccgtggttattacaaggcttcccaagactaccaaatgggtttaccgctcccatgctccgggaaccaatattgggacaagccatggggccaaatgacgcacgaggagaaagtaatatcccttcggaagcgcctgatcacgcccttctcgcaagagaccctcgaaatgctggctctgctcgtgagcctcaagaccatcgacgtcttcattgagaagttcggcagcaacccccccgctggcctccgcgatttacctccaaacgacgaggactggggagactggtggacgtcccggttcccagacgaggaacaccaaaaccccgagaagaagtttcaagcgccgcatatcaggtacacttcaatatacctgcacaaatcgtgtatgcagactcggaaagcgctcgaaaaggccatagacgaggaccccgataaataccggttctccaaaccgatcaacgagatcgtccaggaggaggacatcatgcctgcgctgcggtcgatgcggtcgcttgcaaatgggtggacggatctgagtcgcttcgagttcattcttgtgatcgtgacggaaagagtcgccatgataaaccacatgcttgatccctatcgagccgtcgatggctttgtgaggaaattggatcgcctgccgacgaaattccgaatgagctgtttcccttctttgcaaggcgagcgtttgatttggttgtgatggtcatgttgttagatatcatggcctggatagcgtataattgccaatcaatagcaatgtattgaatttcgagagcttggttgggacccgtaacctttattgactattgtcccataaccttcattggttattgccattctgataacaagatggatgtgatgtcgctctactatcgtctgggcgcaacgatcctccatgctgtgtgcaacacgtgtctatcattctgtggtattaaggctgaaaataacgctccaatatgctctcttcgatgactcataaagacaaatcacagcctgtgttgatttccataatcgtaaaatcccttgccactcttcactcccaggtgccccttgtccaaatactgtttcaaaaaagccctaggctcttcgggaatgtcgctcctcgcctcagcgtagtgctcctcgatatccaggacgacatctagcccaacgatatccatctgctcgaaggggccctttggagtcttcagcacgcccttgaaaatcgcatcgagctcctcgggtgtcccggcgccttctgaggcggctaggagagcctctctcttgattgccgcccatatcctgcagaaagaaagtcatggttaggtttttttttgtttttggggtgcttgggtggtgggacgagaagttgtcataccggttgtacaagtaacccattgattggctccggacgtggaatgggtcgaagccgtgctcggcgcaccgcttcatcatgagatcaatgtagggcgcgtgtgtcccctcgtggcccatgatctcgatggctggagtctcagggggccaatctacagattctgctgttaggttcaccgcgacagcaagatgtaaatatttagttacgtacacgtatgcgcacttaggacgcggccgctgtgtctcagatctagacctttgatgatctcggcgctcgagtagctgctcgagtttgacgcgatgatgatgtcttctggtgccacggcatccagctgtgaaatgacatcccgcttgagaggcagcttctctggcacgcactagacgcgaagtgttagaaactgtatctaaagcgagagctggatggaagtacctcgacgacaagccatgagctgccaagggcttggcttagttgacttggtgagtgggtaatgatctggcccttcttcgagtcgggcgagtcgcgctcggctcggaagtcatccacggcctgcacggcatcttccaattgtctttcttgcccatcgatcaaatgaacttcgttccccagacttgaccactgcgaaagggattagtgaatgttcaatacgggactggttgggaggccatgcgcaccatgtaggccaggcgtctgccctgcgtccctgcgcccaggatggcgacggcgtttcgacgagtcggcgcggctgtggtagataacatcgtgatgtctatattttatggatgaaaaagtattgaagcaatagtaggcagacatcacatcgagtgagggcggccacgagggttttagccaaagtcggggtagctgtcggatccgatacttgaagataatatggggtagcctaagtatggggtaatttttggttgcattatcgttggtctcggatccgactggggacaggatctactagtagattcgggatcgagactaaatgaaggattaatggcaattctgctgtcgatccaaagtccatccggcatttgaatagcaggaacaatattgtcgaatcagaacgaggccgatcctagccctacgcagagcacatgcctgcacacagaatcgcgggacagacatcgcatcccagctcggtaattattccgtgtactgcccttgcatagagccatatggatcctgccacggctctgagacgcctgattctgagggcgtcgcgagcttcgtcctcgccgcccgcactgacttggagctctgcggcaggaggctgagggtctgctccagcatggactgcagattctcgtaagactcgttcgtgatcttgccctcgccgtaatctcgctcgaccgccttccggaccagctggacgccggcaacgatgtgatgtggatatggatctatagacgtgagcggcactgtgatggaggattttttccgctgcctcccgtctctctcgcttgttggtgacaccacgctgggatcgagagtcaccgtgcacgtattgtgaaggccgaacacgagtgtgttcatgacggtgttctctgcgtcggctgcagcgtcctggacgccgcgcagcaaatcgaagcgttccgtcgcctcgatgatgtccacgagcattaatatgctcaagtgataatgtaacatgagtgagtcttgagtaattcgttagctgacaatgacttgagatctatgggttccgttcaaaaaaaaaaaaaaaaaaaacttacaccaacgcagcttggcctgttgccctaaaaattgcattcgcctttgacaggcgtctagatgaggacggaaaatcaggtcgaattgcttgatcgcgtctacgacggcattgtacgccttgaggaccctcgactcgtcatgcccatcccggagagcttccttgaacacggcggtgagcttccaggccagaagcttccagccagatcccacggccacaatctggttggctctctcgtcggtcatgtccaggctgtttgtcgaccacccttgtgccacgtcgtcaaacatcttcgccttgctgcggatcagacgccagcagagttcctcctcgtagccaaacagcccagacgataacagcgatctgcagttgagcgtcagcgacgccgaggtgtcgaaggtgagagcagcccagtatgcggtgctctcggcatggatgaagttgaaggtgtcaatggatcccgggcttgtcgggatgatgtgtttcttgagatacggggagaccttggagccgctgaaatggaggttcctctggcgcgctctcagaacttgtatatgctggagcgccgcgtgaacacaggcctggccggatatgccatcaacttcttcctcttcggagatgcctactgggatgggggtcagggcaaataggaataagctgagcatggaacggtagcaagggcgattaatgaccctcagcatatcccggcgagcatatcgccataggttctgcatcagagcgctggtttcaggatcattcgaggaggcacctgttgctagaggaagccagcgagaagaaaaggctgcagtagtactacgcaaggactcgtcgatcaaccgctcttgagcatcgtccctcgcagatgtgttaccggctccaaagtcatctgccatccatttatcaagctgcctgcagaggtaggatatgctcacatgcttatcagcaaacgcattgtccgttctggtctgattagcacccactcttcccaaggcgattttgacgtagagatgaagagaaaacttcttacacgaaaggattgccgtatctccccatccacgagccgaagacggtttcatagcccgtctggtaaatcagagacagccattcggaatcgctctggctcagcgggtcaggcggtccaccaaaagaaagcttgagtagagccgtcgccgtggccctggtgctgtgagactctgaagagaacgatggcagtccctctgatcccggcgaggagccaaacccacgagctgccgcggtcaatacgtcccccggcgcattctgctgtgaggtggccgtctcgctcgccgagactgaaggctgccgccgccgccgcttccgcttggttgagagcttcctcgaagcagacgccttgttttcgctcacccactatcacagcccaggttaacaatcaagtccatcgagctgatttatgcactaccacgtcgtagaccaccaatcctccctggttcgcttgctgacgcgcgcactctacgcaacgtaccttgaacgtacacggcttctgccgcttgaggcaccgcgtacacgagacgggctcctcggatccctcagcctggccgcgagacgacgcatcgcaggcgacgcgggaccggcggcactcatcgcagctcgagaactgggtcctgcgcgtgaccagctcgctttgcatcattgtggcgacgggccaagcagggctcactctggtcggctttcctgccgctcatgcacacagaggctagcaggagcgggtgattgatacgcgattccaggttgagctgtgttccgaccgctgcctgggcctggcataaactgcgaatgatccccccccacacgatgcaattcgccgggagggagattctaatctcagcctcctccccttcccccagcccagtccgagactccggtccactcccgcaccgaaatctgcagccccgctgaaaatgcggggaattgcttcaccggcaacctccgcctgatcgcactcatcatccagccaatcacgcatcagactgaggagtccatagcatcacagttgctgtatgccatgtaaacctgaatttggaaatggagatgagagtcctgaatctttctacctcaatacagattgtacttggatcttaaagaatgcttgagataaaattcatcatcattgcttgtattttctactcggtgagctagctattcaactaaccaccaccggcgaagcggtagtagtagttcttctggttgttgagtttcttcccaacaacgtaatccttcttcttggcgaagtccgcctcccgggttctacctctctcctccgacttcttgaccagctgtcgcttttcatcggtcacgccggtcatgcccatagctccacgaggcacaatagctcggctacggccaccgcgagttgcgacttgatcatttgctccggcatcctcatcatcgcttccacgttctccattttcgagcgccaagcgttcggctctctcctcaggcgtggggtagtgagtcaagttctggcggtaatacttgttcagggacctgtggccgactgatttgcctgatggcaagtgaagttcgtagtcatcaatgtaaatgtctggatcacggcgctttgcgcgtcctccttcctgttcgtcgccagatgcagagctatcagtttcccagccctcaccgtcatctccatcgacctcgttgccgtctgcatcggtgatcttggaggctcggggagccccaagtttggcgccacccttgtcgttctcctcttccgcgctgtccgaaatctcttcctcatcctcagagtaagtgctacggaagtcatagtgatctccaatttccagctgctcctcttctgtgccaaagggaatcttgcagtgacccttgtctctcatgtgtgtctggataccgaatacggtagacttaatcttgccacagaacaagcactcatgtccaaggtggactttctgctgtaattgatcgacaaggccgtccaagttaaccaaataggacttctcaggtataaacatgccgtggaagcgttccatgtgttgagcgttctgatctactgttgtcgagctgtaattacagaagatgcaggatgtcaaggaccaggttggttctgactgtgactggacaggggtggcgttgtttgattctctatcggcggcagcatcatctgttgccttatctgagacgggatgggggttcgatggtcgctttacgggcgaagggcgctgctcttcatgtgaaatcttggcatgctggaaaccttccaccacttggttgaactctgcctcagcagcagagtcaacagaatcacggcgcactgctatgggctcgcccaatgtgaaagtcgagctaacaactgatgttgtctcgtcgtcagggcgctggttgcctgaggaggccagcttgagcttgtgcttttggctggacaagtgattctggtaggcattttcgctataataggtcttctggcaagcctcgcatgctctctcgaaatgaaccttgtcagcttcagccgtggtagctgctcgggcctgaaggaccttgtccgtgaaaacgtctgcagagattggagggagcgaagcgactcgacgtttcaggttgtatcgactagaagagggatgttagcatctctagcctattcaaaataaaggtaagattgatatcacgtactgccaatcgctcttcatgtggcccttttgcaagtcgatgtttctataggcgacttggcatgtattgcaggtgtagggatgggaagccgatgtggctggctgagcagcggtgctcgccatggtgtctaagccggtcgggtggtgccgcgatggtggaattttctcgtggaatataccaggtttgatcccttggttgactgggaggtggtgaagttggccgaaatcagagatcggcagatccgacgacgcagctgggttattatgtcacttcgagggaaagaaaggtgcaggtgtgacaatgaggttttgcatttttctgttcggtgggtggcggggttgttggcggggctgatcttatcaataagatactgagaagccgatagcgaccgactagcctgatcatatgacgaaggcggacttggcgaagaggccgaggagcaagttccaaagcaatttccttcttgcttttgctctgtcggctggactctattggctctctctaagaaacatctgcaattgtctaggcaggcgagctccatgacacattcttgcaacatcttaccaaacagcatgatgatcatttcctcgcttctctcgtctcagctggcgtcttctgtggatgctgacaaataagagggtcactcagcgtatgactcaatgagtcgtcctcactcgcccagcagggaacaggttgcctccactatccacatctataccaccaacgagcttgcacggagtatgtgccatcagagcgccacaactgccgcgacacaaatgtactatatacttaggtaagtgctgggccttccgtcgttttgggcggctagttggagctgtgagagggtcctgacaaacccggcttctgataaaatagtgctagctctccaagacggtgttaggagacagggaaggaactacaaggtagcaatggcaggacaaagaatggaagcaacaaaattatgcacctgctcgtaaggtggctgacgcatgccaaggttaattgcaatgccacagacgcgcttgatgcagatctgcttgcaactaccctttttgaaagaatcctacggtaaggaccaatatgacaataagcgtcctacaactaagtacgccttgactatctgttctgagaagatgctatcgataaagctggtcgcggaattgcctctcactgacagtgtgggctttagcttcaccctgcgaagtaggtagctaaggtaggtaggcaggcaggtactaagtgaattgacttcgattcatttcaaattcaacggaacaaaaaaacatatatattgtaagccttcaatattgagagaaatgggtaagtgtattgcaactatcgagccagtttagggtttgaggctgaaagcttgcatgcaagttggcgctgggctcatccttcccggatctgagcacaattgcgacttcccttctccatggcagcactctggggctcgttggcaccacccacgcagcacacagcgacacggcgcagaaaaattgtgggagaggaaggccacagatgcccgcatgaagcgacgactatcaattaatcgcacagagatggacagacccattcaaagtctcccaggcgaaaattgaacacggcacgctggcccaagacagtttcagcgcttgggactgcaaaggcggtgggtcgcctgtgtgatacggaggtatcaagtacaaggattaggtacctacggctgatggaatgtatggacatggggcagtggctagcaggaccaaagaccctcccggcggcagcgtcctacaacctaacttttgggtaccccagcgctcgctgcccgtgtctaagccgaattcgattaccagagaccagggggctccaacctgctgctcccattcctccagccattaacctccgaagcctgggccagcatcgccacacgttccatcctcatcctggtgcatcccctctccgtcttcaccttcatgcttattgagggtgtcgttctggccagtatgcccactctccctttgcaaaactagagatcatttcgcctgcgtgatccagacagccggacagcgcctcgcggcgcatccctcgtcgatcgtcaaccatggcgcctgcggcttcgcccttctctcccgtcgcccagccacatcgcggccacccggaccctggtgtcgaggatttcgacctggatctgacttcagggctttggctggaggctccctttgtcaagttgccgccagacgcaccgcccgagcttcacgactacgtcacagacatccatgatccccggcgtgtttatgctatccatcgcgcaagccgtcggcatgatttccagtcgttggtcaacaggtaagctactctctcaaacgaagcccatcgccaagagaatttccctatctgactcttccacgacgtctagattcatcttccagcttcgccatggctgcgggtcaccgcagtgctccaactcgacttgctttacatgtcgcaaacgattggccgggaaggctccgattcgacgatacaactcctcgagcgcgagaatattagcggttcatcttgccagccaagaaaatcccgaagatgggctgtgcccataccttcaacagcacagcaaagaggcgtcagaagcgatgctgaaaggtctcatattccaacctgccaatcgacccggcagactcgctcttgaggtcaggcgcccggagatccaatcgcactcgactccctcgaaagcaagccagcgcctctcgacccgaaacggcgggcaaaaacctccacgctctccaccaagcacgaaatcgccgcgaaatgaaaaccagctcaaatccgacagcgaagatgaaggccgacgctccaaacctcccttgtccgatgaacacctttcaccaacaaggactgaatataaggttcgagaacgaccggcgagtaaagaccaccgttcctttgctgctaacgtgtttggaactgttgctttccggatgcttgaatggttgactccgcaaggccacgccgcaatcgcaaagaagcttgattttgccgaggtggaccaccccattgtcctaggaacagagtcgagcagggaaggctcaagcgcaacgtcacccaaaactgaaacctcaagaaccccaagctttctgagtggcgatccaccggagagattaggacccgttgagccgctgtctccatcaccaaaggatcctgtaaaatcccgacacagttctgaggctacatttcgaacacctcaatcatcgtcgaggccacggaggagaaagtcgctagagctaccgacaccgactcccacaatggacgagcctagatcaccaacgaaatctccaagggtatctgcatttcagccagataagctcggctggcccccaaagtcgaattctacagcgggcgtcacaaggaatatacctgatattcccctcaagcccgtgtttttcgataatattgcgcctcctgcaacctcccccagacttcatccacctgagagtccccgaagtcactcttcggatggccagccaatacctacgtctgaatgtcaaatcaaaactggaatcaatgcgcagagccaaaggctggaggtaacggaactgaaacccgagctttcggattctgaaatgtccgactctgagattgactgccccttacctcaatctttgacgcacctgaccgctagagtcatcgactttatatgtgatgtgtttgatgaagatagcacttctgagagagctattccctacgagcttgagtcgacagaggttattcctcaaccccagagaaagtatagtcgcctagagagaacgcactggccccgcgaacctattcccaggcggcaatggaaagcctttaatgagcagaccctcttccatgttctcagcaatccggagtctcttatccagtcttttacggtcgacggcatattgctggactcgcagtcgctctggtattgtatgcttcgtttgacccgagcagcgccaaacctcgtatttcacagtctctggatcgcggctggaagcctctttttaccaccaaagtccgtacggagtgccagattccaaaaagccaacgttacaagaacccgccagaggactctctcagaactagaagctggatgcattttgtcaatctgcttgcatgctttaattgcaagtgttcctttttgttcagacacaaggcaactagccgaaatgtggcgaattcgctcacgagggcttgcctcgagtgcactgtatgattcctcagaactaccatactggtttcgagaggactttgatgatgctttctcgaacaatcttgcaatcaggctagctcggcgtttgtgtggagctgtcgaagtatggcatcactttgctgtggcagtggggagtatgaagggggaaccgaatgaaaccaagagcaaaatggacatactgaagccatttatacaccagattggcttatccggcctcgattctacacccgtcctagagtttccagtcgcagagcgtctgacacataaaaaacgcgtgcaaagtcttgccttggattgggcgaagacagttttgctcgatgactgggatggaaacccaaattttgcagccaatagccccagctctggggcgctgtccttcattggctcgatgcgtaagtttttcctgtgatttcaactttagtagtagacaattatctgacctagagggtgtgtgtagataaacgacgagagcttctccctctttgcgagtcgcgataccgcttcgactatctctcagaaagacttgactcgatggacgtccccgtcaaatgggtcaaatccgagtacgaccagaacaccagacatttactggattatcctttcttgttcactccagagacccttgtttcattcttccggtccattaacttctccaggatgaaccgagcgtatgaggaatccagctcgctcaagactcggatgagtgtaattgttgacccaggaagcctcatcacaaacccacaccacaagaccgtgcttcaggatatgctcaagactgcatcgtccaaatacttggtcctctctgtcgatcgaaaacatgtccttagagatgcgttcgaccaattatggcggagggaacctcgagaacttcttcgacctctaaaggtgcgccttggtgaagacggaggagaagaaggcttcgattcgggcggtgttcagcaggaattcttccgcatggctatcggtgaattcctggaaccaatatacggcgcatttattactgacgaccggacaaggatggcgtggtttgcccccggctcagtggtggagacctggaaatttgagctcttcggcctgctagtttcgcttgccgtcttcaacgggttgactttaccagtaaccttccccaaggctctttaccggaagttgctgggctggcctgtaacggaacttgctcacattgaggatggctggccagatctcaccagcggattaacaactcttcaggactgggatgaaagagacggagctgtcgaagatatctttgctcgaacatacgagttttccgttgctacttacggaagccatttcagtcgggatatgactcaaggggactccccatggccgcaaactggaagatcctcacctgattcgcctaccgaagcaggggaagaggcgccgcttgtcaccggaaacaaccgtcttgagtacgtgaacgactacattcggtacctgacgagcgtctccgttgggccacagtttggtgcattccagagaggctttcgtgcgtgcctagatgcgaaatcattaaccctcttgacacccccgattctgcagtctctcgttgaaggcgttcaagaaatcaatatttcggagttgcgagagtacacgcgatatgtcggctggaacgcatcacatcgcacgattaaggatttctggtcgattgttaagcgctacgatgacaacatgaaacgtcgattactcgaatttgttaccgcatccgacagagttcccgttggtggcatgcgtaatttacaatttgtggtacagaaaaatggtgaggaagagggcgagggcggccacttgcccacggcatatacgtgctatggaacacttttgttgccggaatacagggacaaggaggtgcttcgggagcgccttggaatggcgctacaaaattctcaagggtttggatttgcatagatgggtactggaggaataacaggcgtagcatgtgtataactttttctactatttttatccccttttctggtattaagcgatgggcactaagcgattgggtacttagcgataggcactgcatgggataataagaatcgattctgtatagcgcactctgctttctcaatactatcactacatcttctacgcatgagaataaactttgacacttgctttgatcgttacactaactaaggaatttgcataatgcttatgattcttaatggatagcattcaaagatgcttttacccgttctccttgttcatcgctcataataatcatattggtcttctatctacttgatttgtctcacgttgagattcacccgcttgttcttcatccaaccacgccattcttcgtactgcccatcctcggttgctgggaagttctcgagatgtgccgggcacgtccccttgatgaccttgggtacgccgtgccatgcataccgcgactcgttcgtcatgtagatggcgtcgccggaccggagcggtatggtgagataccctttgccctgggcggtatcatacgcccccggggggagctccgcggcagaggcgtcctccttctccccctcgtcctgcggccccttgctgggggcgatcataaatatgccgtcgcacccgaggctcaggctcacgaggccccggtccgactcctcgctgacatcccggtgcatcatcatggtgtcccctggggtgtagaagttgacgatggcagcctgggcctgggtctccgggaagagggcctggaggaagcccgcgatgtcggcagggaaccgggggggctcggcgtcggggtagacgcggttggtccagtcgtactggccgcccagggtgacccagtgaagcttgcggttgagaacctggcggagggactggggccggtggacggaggggtccttggggttgaaggcggcggcgggggagtccggcccgtgggagaagaaggaggcgcccgggtccagggactcgtaggggaccttgaagtggaggtgcatgtttgtctggtggttggggttactaagatcacggtggatcatgagttctagcagcttctgctggacgttctcagggacgaggtttggcagaattaggagtcctgggatccggcttgttagttgtgtgtacttgactcaaatatggggtaggaagggaagagctcaaacctggaagaagaggatggtgaatgatctgcgcatcttcttgaacctcttgagagaggccgagttgtttaaaggcctctgtaagttggttctttgatatcgatcctgccgagacgaagccagtctcggagagaggaagtctagggtcgtcgagcttggtttcgttgagcagctcagcaggctctttttttgagaacgacttccactccgccctcagctcgtcagacggctgctcatgggcatccaggtcccccaagttgattgtcatgttgagttgtagccttttttatactgttcagtgatcggatgatctgcgagtaaaccccacctgcaatgagtttcacgaggtgaatatagaaatttcgatctatgtcaggcgggatgagccgcgaattctcttcaatgactccgtcgataatttgtatttttgcccttgtttcactttcaccacttctttgtttgtagttgatgattttatcaatccctattccgggcccatttggacctgatggggatttttacttggtggtttagggtggttgccaggcgcatttcggctgacataagcacatttagccttgcagatggagttctccgatatcaagactaaacgtctcgctttccttcgctgggcagctggctgatggggtagcaaattcgcgagactttggccgcttcgcagaggagacgaggtatgcacaggatcaagtcgtgtcgatggcgtgagttaaggtcatttggctggagcctccagccgctgctacaaaatgcccgacaaccacgccgggttcgggtcaacgaggctgctgcactcgcatacagctaccacagtcccgcagacgattcagatcaccccaaacctaaagtgtctatacctagacggctgccttatgactgggaggaacaaaagccagtgactgaagagccaagcccaatggtcgaggagcaaaggctagtggccaaagaggaacgacaattggtcgaggagcaaagacgatggtctgaggagcagaacaaagaggtacaacggccctggccaagacccacgaaactccgttatgtcaaggtccatgggagagcccatgagacgtcaaagcctccagagaaatccaaggccctatccaaatcacgacagcggcatcaaggtctgaaaggtatcatggtggccaagaaattgtcatcagactttatctgctttaaggagggctctgacaaccccgcacccattacccccgaggatgaatcaatgttgtccacagcccagcagtattttggtgaggcttaccaagagctctactctgcatccaggctgagtgagcatgctataaacacgactgtcccggagattgcactcatcggtgccatgggaactcgaaaggccacattcatcaatggcctgtttgggctccccgataactacggtgttggctctttacatgatgaggtgatcaagatgagtatgtacggggtcaatttccccgtcggatgccaacatgggaaaggtctacccatcaagttaagaccgccgaacgggttcattctcgcggacacccccgaatacgccctcatcaagcgtccttcctggggcaaagaggtggtgaattatctggaaaagcgggaaaacctcaagggcgccatcctccttctctcactatcgaagccctttcgcgagatggacaggtgggtgctgcgccatctcgctcacaaaagggtcaacacaagcgttatcctcacaggggcacagtatttccctaaaaggtgggaagaagtagccgcgcagcgtgctcggcaggttcgtcaggagatgattagcctcgacgtaaggcttgacaacggatgggttagaaataatggatggatgccagacatacacgtcgtggccccagggatggagttccagccaagcattggcaatggaggcggactgggaggcgcccgaaaggcaattttggagctggctgggtttgatctgaccaagaccttccaaaaggacatttcggtcagaggtaacctcaaccacgttgcatcatttaatacaccagaagcatgatatgctatgcccggctttaggtgcttctaccgtcgtacattatcaaatagaccttgtatatgatcgagtataccatttgcttcatagacgaaattacaacatgctttgaaacccccgtgaccgcttatgactaacacctgatgtacaaaccacataaaatcgaaaccacacttgactgctgggagagtttgcagtagcaaatgactgttgctccaacccaccaaattagcagtctctataacctgcaaatactatatcgcgtctaattagcgaccagcatgcatatcatcccattctcatttcgcctcatttcccatcgcctgtcgtagcggttgaatgacttgtgcccggacggctaatcgacatccgcttccttgctcctttaatgtcaaatagagtcttcactttcttgagtctcgcccagcgagccttatcctcctcatcctgcgccttttcgtcatattcctcagcgtctagctgggaagcgaaatgaggtgaatcgttgactgccgaagcgtccccagcaaccggtgtgactgggttagcatgagaccgccgtacaggcgtggaggggttgctgggagcctgcatcgacttgggccgactctttgaccggcctgcgtacaaatctcgtagatttgactcgttcttgatagtctgaagcaggatcttccagccgggcagagcctcaccctccgaggtcttggcgttggatcgtttctgggtatcctggttcttccaaggacagaagaatcgatgttcgcgaacagggtcgagatgatccatcggtgcggggaccaagacctcaccgtcctcattcacttccttactcttgaacatccacaatcctagtcgtctgaggcaagtttgacaagaggctgagtttggcactggaccaatgcgtgaatttgatagcccctgccaccccaacagggccagtgctaacgctggccgattcggtgttttgatagaggcttgttggccatttctgaagaagtctggaggtagactggccaatacctcacccagatccaagccctccgggagtcgtatgttgaattcgtacggtaggaaggattcacgtgaacataactcatcgtatcggactcggagttcctcgagagcactggtcgtactagacaatggaagacgaagaagagaacctatcgagtcattagaaagaaaacatcggtcaagacgcataggaggtatcactgactttctgagccccgttttcgccagagacaatcgtcaaaatgcgcgctgacaattagctcctcatacttttcaataagaccttcccctgtgacctgttagtaaagattcatgctgtatggggaacagggagaagtgcgcaccgatatctgaggaaacgagcacggggatttcttttccgtcgacgtttttcctgttgagtttgacgacgagctccttgtggcacagcacacagcgcaccgtttccttgcccttgcaaatccaacccctctttgcccattcaatttcgctcactctatcgggtttgaatgtccagtctgtgagctcttggaaagtagccagccgtcggaggagttcactgcggtcacccgggcagtacttggccagcggcttctcgggctctcgtttcgtgtcggtccgtcgcgggctcgttccaacggtcgaggaaggcgatcctcttttcccgggcgtcgggggattgctctgaacgggagagttggatagagggagacccagcctgcgccgtttgtcgagaaagctctccacgtcactcgttttctgtggagtccccgggggccgtgaacttgtcgcgtcggcattttggcgatcactcgaagagcgactgaggccctggagtaggttattgaatttcctcttcgtcgagttcatgttttcggcacgtcttaagctattttggtaggagacatgggatatgcagaactctatgtcgacgacgcaaagaggcccttcatcaagtgtaggagaagttctcgtatcgctagactaggattggagggctgccttggctttcgaggtcgatagattataaggtagagctgaaactaggtgacggggtatgttggctatggtgaggttgtttgccgaacttggttgtttcgccaaccagtgtttaggctgctgataagctgataagcttggaaatatgagaacgacctgagcaggactcaattcatgacctgcaattaattactttcaaattaagcaagaataataaatctcagatacatgtttgaaaatctaacagcacacaaatcattttgctatgaaacactattgaactcccttatggtctggtcgaacagaacgaaggaaggcctttgtcttgtggtgccaccctacttgttttgacgccttcttactcaacacatggcgaagaaagcaacacatccatttttaatagtttcaagtaccatcaatttgatgatttaagtagtgagtaatgcatgattgacaatggctcgttctttctttggtggtcgatcttgacattttgtggagcacaatgaaactatcaaggagagaccttcacctcttatgctctccctgacggcacaaataaagaaggtacgtagctcatctgtggacgcaaggagaggtattcgcatgagttaagaagcaaacaatctgaggattcatataggatcatcaggtctggatcttacaagcctcgcttctttgccaataattcaaagtccgctcatgatcacatcacattgatgcagatgaagaatgacggaaagttattttattttattttcaagattcagttaagttacttaggccattcgttaggcactagcgacctccagtaacctattgagtagcttgctatggtggctatagggtgaaggatccagccgagcatcagctaggtacttcacaccgggctctgatagggagtttgattgcccttaataaaaccaggtaatcaatatgaagcttaggcggcatgatatgtaaaattcggatcaactttaggtgacttcaggaggagactcgcaatcttttggcggccattcttgatggcccatgataaaggagtctcgctatgcttatctgcaatgttcggattaactttaggtgacatcagcaggaaaccaacattcgtctcttggtcagtcttaacagcccaatgtagaggagtctcgccattttcatctacaaggttcggatcaaccttgcgtgccgcaagaacttcataagttatgtctgatttccaactttgagcagcccatgatagaggagttcttccagttttatctgcaagattcggatcaaccttatctaccgcaagaagagctttgaccacctcttcacgatgactttgagcagcccataatagaggagttcttccagttttatctgcaagattcggatcaaccttatctaccgtaagaagagcttgaaccacctcttcacaataactttgaacagcccataatagaggagttcttccagttttatctgcaagattcggatcaaccttatctaccgcaagaagaactttaaccacctcttcacgataattttgaacagcccatgatagaggagttcttccagttttatctgcaagattcggatcaaccttatctaccgcaagaagaactttaaccacctcttcacgacaatattgagcagcccataatagaggagttcttccagttttatctgcaagattcggatcaactttatatagcgcaagaaaagctttcatcacctctgggttactaagttcagcagccaatgatagaggagttcttccatttatatctgcaatattcggatcgagcttgtctaccctaaggaggagttcgataacttcgctctttttttccaagatagcacatgagattgcagtgcgtcccgctgagtctgtcatatttggatcgaccttggctatacccaggagggtttggacggcatggacatggcctcctgaagcagcagacatgagcggggtcctcccatacgcatcctttgattctgggttgccattggaggtttctaacatgacctttaacacctccgcatggcctttttgagcagaaagatgcaagagaggggtaaagtcaaaatcaacagccttcaatccgaggcgaagtagaaacgaaagaaggtcttcgttcccagcttcagctgcttgtttcaataacgttttcttttgtgagaatttgaatgtgcgagccagcgcgaagtttggacttttatgatggggagatgcaggctcttctgatagagccaacgtcttccctaactgggatggagccatcaaatcgtagaatttgttgcaagccccgaagctcttcgtagcaattgaagcgaaaaatggacaaccatatcgctcgtcctctacctcaagacaggaggtcgtcgttgaagtttcactcgagaaataacgctggattagatgagatgcatctgcctcggccaatatgtataacaaacttgccatcagtgtatatcgccgtacttggtgagtctcatagatattgttcttcctgatccatccagagcggtcaaaacaagaaatgaatgtaagctggtcaacacccccattctctgccatgtcggcatggtggataatgttttgaacacagtatttgagcaaaggaaataataaatccagctctgtcatggacattgtagggttttggccaaaggagtagaagaattctagctcaggattactgtagctcaggcaaaattgtttcagcttttcatggctattggcctcaaattttgggtcgatttcaggccagatctttgccaaactagtgttcttgaggaagaactcccggacagactcgtgaatgaattggacagtgggctgtttagacttggtaacttcagcgagccctttggatgaatgaagtagaaatcttttgatgatatcttgggcaatttcgtcttgattccaaggctctggagaactagactcgaggccatgtcggatagcaaagtaaagttgttctggactcagaggtgtcttggcaaagagaacccactggacgcacaaaagcatgctgtgccggttccggtcgtctcggaggatgatgtcttcaaatagtttgtaaagatcgctgggaagatcctgtaggcgccgcttaagtgtatgcatattgccgttatcatattccttgttcaaaatagccacaacaagaacaacccaaatgaaagcaccacaggctttgttttgaacttcctcgcgtattccttttgccatgttgctttcgccgatcctcagttcactctggatataatttgaaatatcggtactatgaccatcttgctcctcaagacataagctgaggccaaaattgatggtgatgtgtggataatgtcggctggagaagaatatgctcaagtgtattgacggatgctcctgtcctatgttttcaaaaaacttgatcatgtctcgaatctcgtcctcatcacactcatctagagcgtcgatgaagaagacgatggacactcctgctaattttagaagggcctgcagtagtaattctttcagaggctcgatggcccatgtttggcgaggcccaatcctagtgcccaattcaggcgagtcaaatatgcacttttgattgggaaattgctcgaggatttgcacgagcaatgaccggtacatcccagttgttgatctctctagcggtgctcctcgtgcattgaagaagaagctaaatatgaacctgttcttctttctgttctttttggcctcgatataagcgaatttcatcaaagtagactttccagtcccggggtttcctttcatccatagaaagccttgatgggcaaagactttctcggggttggtccaatcacgatattcttgggtgagaagtaaccatctgcatgtcttgctgtgggccttttcgattgtaagaacccgtgcatcgatttggtcgaacttgagcgattccaagatagctgctttttgttcttctgtaagagatggccttgcaaaggctgacacttgtggctcgatttctttctctggtatatccggtagcattcgtctcagggctgctccaactttcttaaattcggggtcgtctactccagagaagcggcacatcttgctgtgatcttgattgatatgttccactatctcaagatcgggaatattcacatatgaggaagtatcctccacaaccttggcattaagttagttctggtatcaatctggatctcatattttctcagcggaacgtaccttttggccaccaagggccttgaagccgtactgctcttggaaggaatggatcttccaccggcgctcacgagccattagcccgaaaacgtcccgcaactcgcgtaggcgatctgatgttgggagaagggaagccctgacattttcgttcacggaatgaccaagagctttgagaaccctttctccaaagtgaagaagcgagcctcccggatctgcaccggagtgtggggtgccgaaaaatatgatgccgatagtagactcgaaaatcggacgaatgtgtagatggttctggttgaaggactggccgcacctacgaagcaagtccttgacaattatacccccaagactgtgagcaatgaatattatgggcctctgcggctcatcttgccgttcagcttcgagtgcgatagagaaatcattggatatgtcgtacacggtgtgagtgctgacgggcggcccaaatagtcgctggattttggcatcgtagccataactcaagactcgtgcatcggggacgactttgggaaccaaatcccggggccagcagacgggtccatcttgagaaatggcacttatgggtttagatcctggctttaattttcggaactttgatgggcgaccttgatgctcgtcgcttcaaggctcgttcctggatgtagcttcggcggacttatccgtccaggttcgttcggggtggccgttgaagccatgcacaaagacgatgctagacaacattagtttatcaccaaatagagaaatagctatctggaatagtactctagacgaggattctcggggttgacaatcacgttcaaagcgaaggacgcgatcggcgcttgtcccgtgggactcactatctcctccatctggcgacgcctcgactgccgagtttcgatctaggatgtattcagaaaaataaagataattgacagacttttcatttcttcatttgaggagcgtttggggagatgctacttgtggcaaagaaaggcatatcctaactacagaggtggcagagatgccttgccgcccgccttgcatatatattcattacttcacagcctcactatgacttaacaaccaatcaaaaccaagcaaaaaacgcacgcgttcgcgcccaactttgcttaccagatggtacttgatgtgtcctgttcctaaaggctcgaaaactacaattacaaaggaaccagaagggttttacttcagagatatattgttagactttatctcgagagttaggttggatttttaaagcttagcagacggaagaaaatggagaccaggcacaacagccccgatcaataaccaaccagcacatttactcgtgggctaatgtgtggctgtggtatcactgtgcacaagctgacattgaaggccactcccgagtgtgggggtggggtccactgataagataaggaaaacaccttttttttttcctgcctttttttttgcgccgagtaattcgttaccgctgttcgacccttcctgacttgctgggcctgcattgccgcaaaacacacctggatacccaattgaacagcttgggtcgcggtacattcgacggcacggtcaattagattttggtcactgtttccagcacatgcccggcacgaataacagcccaccctcgtggctcttctccaacaactcttccaacccccagatcacctccaccacaatggccaagaaggaaaagaagagttctggcgcaaaggccaaggcctcctccgccgccgcggctatccccccacctagtcagctcctcggtctggttgacgggttcctctccgaatactcgctggactcggtccgcagcgccttgaagaagcaggtcgagaagaacggatgggatttgcccgcggccggaagcacatctcttgtagccatcttccagacctgggaggcgtctcaacccgccgccgcacccaagaagaaggccgtcaccgacgatgttgacatgaaggacgccagcagcgacgacgacgctgatgactctggtagcgagggtgacgatgagagcgagcctgagacgaagaaaaagagtctgaagaggaaggctgccgagagtgattccagctcatctgaatcgagctccagcgagtctgactctagctcagaatccgaggacgaggagcctagggcaaagaggcagaggcgtgaggagtcttcctcagagtcttctgagtcttcctcctcagaatcttcctcctcctcctccgaatcttcttcgtcttctgaatctgagtcctcctcctcggattctgattccgactcggagtccgacgcttcggctgtggtcgagaaggcttccaaggtcgcccttcctgactcctccgacagctcctcagattccgactcatcctcttcttcgtcatcgtcgtcctcttcctcttcctcatcatcctccgactccgactccgactcgtcgtccgactctgacgccaaaaccaagaaaaccaagaaactagccaaggtcaagaagtctgactcctcagactcgtccgtgaccgtcaccggcgccccgacatcctccgccctggccgatcctcccctgccccccgacccgaccgagctcaagaggaacggcaagaagcaaaacgtccccttctctcgcatcgccagggacatcaaggtcgacccccgcttcgcctccaacgagtacattaacattgcctactcccagcgcgcgcacgaggacctcatcgtcaccaagggcaagggcttcaccaaggagaagaacaagaagaagaagggcagcttccgcggcgggcccatcaacatccacgagaaccagagcgtctacttcgaggactaaagcgggtggcaacaaaacaaaactaagggcatccatgaaagaaaccggttatcctggggttggcatactccctactactccggaatctctcataataccctccttcccctttatgaatacgaattactttcggggcgttgttactgggaggttggcgttttttttaaaatatataaagattgggggcatatcaaggtccagagaataagagcgttccgttagtgagaaactcttgctttccctttcgatataatgcatttttttttatagaagataaaaaattagatcgagatcgaaatcgtatattttcattcttttgtaccagtaaccattgccgcttgtatatgcccaaattggctcattcactcgtgaaaaaaggaccaactacatagatacccccccttaaatctcaccgcctatacatgcagtatccatattggtccttatatgatgattgtttttaagtgtacatgtatgcaattcgcttcattagacattagggaacgtaggaatagaagcgaagcgtgggggaagtctgaagagtagctcttaacctccctcgacggcaccgggtctcagcacctgcgtggccggcgcggtctcgcccgccaggtcgccgagctccgtctccccattcctggtgttcatgatctggttcttcctctcgaccgcattccagtcgcggttgccgtccctggcattgatatgggcctcgcgcagccactccttccagtgctccgacacgggcgcggcgccgctcgtctgcacccagccgacgctctcggtctcgcggatggcgtaccacagcgtgcgcgtgaagctcgggtggccctcgcgctggtcgttggggtccgtgacgccctcggcgttctgggcgtcctccttggtgatgtcctcccacttgtaccgcgacaggtcccagaaggaggagcgggggagcatgcccagggcccagtacaggccgttgaggaggatgtaggtgcccgcgatgaacatctgcaggtcccacgtgcagttgccgagcaggacgacgctgaccatcagtaaggtggtggcgatgcccatcaggaggcggtacgtgcgctccccgacgtagtagtcgcactcctcagtcccggagtagagttctcgagcgacgtcctcggtgcacttgatgaggaggaaggcaccctcgcgagtacggatcatgacatcgccaggggggacgttgttgttatgcctgcgcttcataagccgcgggcgccagaacgacgcaatgccaacaatggtggaggtgagcgagatcagagtgacagatatgattgcgtttccatccttccaggctataccgcaggctacaatggccacgctgatggagcaggagaagacgctcaagatatggatcggggaccagagcttgggcggcacggcgggacgctcgccgctgagggccattgtggggttggtgaagaagtcctgcgtcgtctccctcagggtcgcacggcgttgcacgggcctgggcggttcgccaggctgggcgaagtccctggcggtggtggtcccgttctcatggggcagctgtgccatctcctcgtcgtcccttggcggcgctcttggcatggccgagcgcagccgctcgggggttttacccggcaggagcttgatcagcttggtgtaaacagctctgatccagccatactcggttgcgagggtgcctacatggacgtcctcgaactggaagttctcgcggtgctcaatcttcagcaccttgaagctgtaggcggggagctcattcagcggctggatgatgttggcgaagtagccgaccgactccagggtcgtgccgctcagcacgcccgtcatcttggccagcgtctcgggcatgcgggttggcctggtggccttgagcagagcctggggggcgggtataaggcgcgggaggacgcagaacagcgaggcagtgatggcctgggactgatcaccgatggacgactcgccaataaccgccagaagggtgacaatgtccaggccccagtccagcttgtcaccggggaaccatgtgaactgattggcgccgttcccccccatcttgatggttgtggtcgggcaaccactttggcaacagaagctcttggagggtgaataggtagtattgcttggggtgggtggagaggataggagcgacgttgaaaggaataaataaagttagaatcacgaatacaggggttggggaaaagcgatgcccatgtgaaaaaataccccggacgctgagcacgaaaatagacgaagtacaggactctcaaacaagcaacgctggctggctgcgaaacaatttttcgaaggatgaacccccaagaggagatgaaacctgacagacagttcccgcgttcattttagagcgggacggcgctaagagccgcatttcagctggttgctccattgggctgggggaaacggcgcgacccgctggttggtgaactccaggtcaaaagtggctgggcgctgacggcagttttgacccctaatgtaagcgctcaggagctgatgtaagcgctcaggagagacccagctcgaggcccggcactcgctccaccgacggtaattgtcgcctgattgattttcgcaaaaagccgcttcgatgttatgagccacacgtcacctgaccactgcaccggccttgccacacttttgttcgacaagggtatcaacaccgccacacttgtggcaccaggggccggttggcagtctgggcggcgttcggtgaggcttcttcaagtcttccatcggttctcctgccagattgattagcattggctcatcgagcaccgccccttcaaggcatgcatcacatgtgggtggtgaatggtgagttctaggcaccagcgacattgtttcacggagaacaggcagtgggatcatattgacagaagctcgattgtttgccaatgttggctgcatgctggtatctagagagaaaggaaaataaccaaagaatggacaaaaaacaaatatgctcgctaaaaaaaaaaaaaaaaggctagtatgaatgcatccgtatggttcccatcataagtcgtatcatccctcataaaagatgcgtttatgttctcgagttatcctcctcgggcttcatttacaggcgctcgtctctgtatgagcggtaggtgagcacaacccacttgaggaactcctcccactcctggttccattgctcaagtgctgtttctcgctctgcatcattcatgcaggagtgttcgatgctccacaggatgagctgcttccatcctgcgagtcccatgtcgttctttccaatcatgacctggtaaaagtcgtgtgatagagtagatctgaagatcgtaccgttgtccgagctgacagtgcagtggacgttgtttgcgagtaggtcgtacatggaatgtccgcttgctcgtggggtcaggcccaggatctcgtttgagatggggcagagctcaagacagacaccgcgtgccttcatctgttgcatgatgtaggggtgtttggccaaggcatagccgtgaccgattcgctttgagttgaggagaagagcgtcgaccaggttagcatcggtgtcggtgccaatctcgagggtctcgccacagtggaacagaaaagggatatccaagttcagattcctgcagttggcctggaactcgagcagttcaggaatgaagtccttgagcggtcgccccttgcactcctctccaatgagatcaaaaccggcaatccactgaggccattcctgcttgaactggatgcactcatccagcgcctccttcaccttttcgggtgagaaggatcggggagtgcagtagatgatcttgaggccctggaagagcctgcttcctttggccatctctgccttgaacttctccacttcgctgataatgatgttcatgatgccgcggttgtcgatggaaccagttccgtcgtcgcggcacagttggttggtgctcataaagtttggtcggatctctgcgtattggatgttgtcgttcatcagatcctcgagaaacagccgtgtgtaccttctgtaggctgtttcgtagttgaagagacctttcatcatccttgttcgcccgttgaatttctcccaagcactatatacaaaaccattagtcattgttacattaggatgaatgatgagattaacttacccctccgccgtctggaggcaattgtgtgcctcctcgtcctgaaaaaccagcttggaagcgagccacttcattgcgttggcatttgttgtcttgcggtatttgctggggaagagtctcagaaactccgagaacttcatccactggcgggcttcgtagtttgaagagaagagattgccttgggtggcgcaaccaacggccttgatcgagaactggatctcacatcgatcaaagctctcatagtgattgtcagagacaagcgggagatcgctgctgatgcacatgcgctccatatccttggcaatgttaagcagcacttggggttgcaggcaggcattgaagtggatatgcaagtggcttcccttaggcatccgccgggcaatgttgaagatctccgtttgcccgatcagatccacgttggagagaaaatggtctccagggatacgcttgtgaagctggccgccgaatcctgtacgcgcgggagccttgccataaacctctgtgcagtcttggttcttcaaagattggatgatcatgtccacttcctcctcaagccttgacgctcgactccggcacttgtggtcaaagccgacagccctgtccgtgtccagcatttgcctgcgagctttgtagtactcatccttgcttcgaaagcccgagtcaatggtatttccaattctccgagctgcctcagcggcttctggacgcaattctggacgtaaagctgtgtggtgagaatcgatgtgatgacgtgcgactgtcttgtcgtcttcagcatcccgtcgtattgacatggtgctgttgggtgtgttttgggcgggttttctaaagggatgaaaccgatggatagctattcttgttgttgttgaagggtccaaattaatatcccggccttgacgaccttccgaaagtctcttggctgagcagaagacgcccattatatggttggaaggggtgcgagctttagatcaggtgttccagccaagctttggcagcgtgttgtatccccctcgtttgatcaatgacctgtaaaacggatggggtatgttttggtgtgcgtgatggaaagtccgtgatgaaaggcttggcgggtgttctggtgtatgttgtttgtgggtatgagggggattgtggaagggagggtggtggtgatatatatcttgcacgttccaagccaaggcccctacgtaatatgcgctcgaggtgggtgtgttccgaggtgcgagtgcatgacattgaagtggatggagccaagactgatcctcactccatgtcgaagctcaaaccccagccaaaggcggaggaaacaggtacctgagctaggcgcggtgatcgttgcaggcgactgatgagggacagcacatgcgggtggagatggaacaacgccgcctagccagattcgacgccaacatgcgcccactggaggcccctgtcttcagtgggcaccccccaagccccagcaccgcataccctgaacctgggctatttgagccaaaccgtgcgctatctttcaggtaggtgaatagcggggtgggactcatacctggcagtgtcctatttgcctaatgcggcgcactgggcagtcaggcgttctacgtcacagactcatccggccattgcattgttcaccgaggctgctttcatctcgacaaacggacatctcaccgcacaacgcatcgggtgtcaatgggcatgtcaggtgcgcttgattggcccgtcgtgtctacgacatcctcacgaagcattaggtcagacagagacgggtctttgccatgaggccatctgcgccttcgattctttccactggatctggtgataagctgacggacaggcatcgcatcaatctcatctgaacaaccaacgagccaacacagccctcactcacaaggcgatgctcgtcttggtgttgttgacgaggtgactctttccggtcacctttcctccgcaatctccatacctccaggcatcatcgccggtaaccaggatcgcattctgcctcttacagaccaaagtcatccaccgcaactccagttggagggcatagccaggcccgtctgacacgcgaccggattgccggcaccagccttactctgctgcctctcgcccacacgagccccaaaaaaccccgtcttccagacatcgcaactgccttcacatatgtgctgccttccccactgctggcaaccaactgccttctatgcatgccataggcgcgtgcgcttagagttggtgccttcaaggcacagacagatttgacgctcagccacggcagcaccagattcctggcgccaggcagcccccactctccccccatggaggaacatcacatcattcggggccgaggcagaatgaaaatagaacgacgaggctcaaatcctcacctgccagccgtccacacatggaggtgggacagagtaatatttcccctttgccgactatgcacctgcatctaaaccccacatcagccttaactgcctcggcggctcagcctggccctttgaccggacaggattagcaacatcggtccgttcatcatggcatttagacccgcatcgccgcactcgaggcatcccgcttgctggtggtcaagcgcccatgcaccggtccattcggcgctagaagtggaaaattgcttgtccagggcaagcgtctatctgttgccaggggagttgtgtgatggcctcttgattgtccctctgtgactccctcccgttgcacaagccacggcgtagctctttgtatctcgatcaccagattcattcttgacaaagtcaatccattcttagatcaggtgacgagtgcagcctgtaggtcttgccaagcgtgtaaggcactggccttcctctgtccaaagttccattggtgaggactctgaggcagagaggtcccttgcagtttgaatctagattacagggttggttccttcaacttacctttgaagggcatcaaagagccccgaaatccccacctcggccaggagatcgaatcgtgaaattgtgcgatacgccgccttgcgaccggggatgtgatgtaacggtttggcggttggtcatgtagcatcccgcctgcgcagccccaaactctgctaccaacgtgcacagtccccgtctccatgcctcatgggcccattttcaaacttgacattcccgagttggcattgcagccaacaaccaactaaccaaccaaccacctttatttgttcccatctgtgcgtgcggaacgtcacagatgcctacaagtctgcccatcgctagtcttctccactcgtgctcccacttagatggcaacgaaaattgcaccctaaataaaaccaacatgaacaaccaacaacaaatatttgagcccctcaaacggatttctggagacgacgcaaattttggaccccttagtcctcgtagactgccctgccaaggtaagctcgtttgcgagctcacaactgccaacacttgctcgcaaaccgtaagactccaaacaaaagagagaaagaaaaaaaaaaggagcacagcccagcatggattctttgttttcatgccagacgccttgcaggaggactttccaccaacattgtttaaaatcaaagaaagctaaactaatgcccttcggccccttcgtccagcccctttccaaactcgcattgtagtacactccctctcatgtacatttcagcaccgtgacaagccatctttggttgctcagcctcaatagtccattccaatgccatcatatggataacaagtggtcatttagtcgatacgaggtcatgttccttcatagagcaggctgggtgggtagagccgagctgcctaataggcacctgagcctaggtttttttccatttttccatgaccgatgaccgctctgatcttcgaaagttcagtctacctcgtgtttattcatcatggagtcaagtttggaggtacagtaccaatctaccaaggtatacttatagctacctcggtcggcggatcacttacaatgattcactggctgaattgaccctcatccttacaaggatgagaaacggcaagctctattacttaagctacctatttactattaaacctcatgtccattagggcgagtgctcgtcatttcgttccagttcatcaacataaaagtctatcgagtactgagcgtcatcaccgtgagtggaattccgttcccgtccctcctggtataccgaccactcacgactagctagcccgtctgctagtttgaggcaagctcgtggtggttgaggtcaatattcagggttcaaataaacccgaccctggggattcatgacaaatgtccttgcaggcggctattcaaccaagtgccatgccttgcctacaagccaagaagagaagtttcaatcttcgcttcctaactaaacaaaacaacccatcgttatctttaagcgaaatagctcttccaaagcactccttcaagatcttcaagttgttcttgcgtgaagtactacgtataggttagcaaactgactcgcataatattccccagtgtggggggaaaagggggttaatgagagggcggcctactttttggtcaacactccaactgtcctgccttgtcttcttgaactcgctcaagatcatcttggtggccttgcctacagtgccaggatcaccagcagcccgtctggcaagggttgccaagacttctggcatccattcggggggcggggtagcataagggaacgcctcaatcaatgcccccaatccgagaacagcagcatgacgcctggcgatctgctgatgcgtgttcacaggggtctctgcacctggaagcttgcgcttgggcatcgggttctttcgcagttgatcctcgaacctcttctttaagaccccaatcataggatcacggataggacgaggtgaacaacggatcataccggccagagtcgttgaagctgaggtccttacctcaatctgtgggtcgctcagcatctctgagaccgcgtcaaatagctgatcacgctgcttcttctttgtgaggaaaattctgcggaagtacacaacttgcatgttgaccaatgcacgtagacgctggtgccagctggtagctgtcttgccaatgcggatcaagccatcgatgaactcagcatcctctccatcacggaagggaatattggggaagtgtctgtagacatggtaggccagcctcataagctcggggtcttccttgacatccatcatatgtaacaattgtcccatgaatggatcggagaagaaggggaccagctgaatacattcgtgcgatgataacgtgcagtccagccacataaggacagtcttggaggcggaggtataggacgaaggtgtttgctggcccggttcgcgctcttggcgccacttctctagctgatcgaagattgttttgatagtcgttgtgaattcctctgttgggcggtaaggtctcagaccaatggacgaagcagccttgtttgcctccagtagcttggtcacattctcaaacgactcgtggtaccgggtcttgtagatcaccgagagcactctgcccatagcttcgcgtacggctttataagggtgatctaggtggccgaggaagtcgtcgagaacaggctgcacatcacggaaatgccaagaggcgtcggagatgacaaactcgaggagttgaaccttggctgactctttgaaagccgcattcgacgtcatgtcaagtttgaaatccctcaaggcagaggtgatctcatggcaacgcctggggtccttggcatcaaggatcatgtgcaagcatgtgagccaatatgagatattctcaggggtcaggtcttcggagagaattctcaagaacatcggcgccgcaaatttccacacgcggttgcgcatatccggcggatcatcgctggatcctgagagaagggcacctagaatctctgaagtggcacgatgttgatgcttatcggtaccttctccatacacattcttaaccagatcttcaatatcttccagggttgctgcggtcttgccgtaatgcaacagatcgaatacatgcatcaagagataaacattgctcatgcgaaacctatcggtggacgcatctcgtggctcttgcttcaggtattcgaagcactgggcaaaccatttcttggtcaaaatgccaccaatctgctccctgatggcagtctcaacctcgtcatatgcctcgaagcggctaggcttggccttgaaagcagtgaactgcttgccccagacgagccatccagggtagtcagcatcgaccatatattcggcgttttctgggtgactgaaggctgccaagaatctattggtgaaatcggcatcaccgttctcaacagggattttgatcctatccctgccattttccttctcggtcagatagttgaggtaattatgaccatagacagcacggatgtcaatggccgtgaatatggtagtgaaggcgttgagatagtagcttctcaatcctgggtgggggtcaatggtgccccgtaccacaagatcaacgaactcaggaagagcgagctcgttgaatcggaggcagagattagcagcaaatatcgagcacctggtcgcaatcttccaatgtgcgcccttggccttttctgtcagctctaggcccagcttcgccttggactcttccacgcgctttcggcgctgttgaatgaactgatgtctctttgcgataggtgcagagacatcttctgatggctcgatcgtctttaggtaatcctcatttaccagaaccatctgctccacagactttccaaactcgagcaaactatacagcgcggatgaaccgaggatttggatagatggcttgtcgataccagcggtttcaatatagagccgcatcgcttccggtgcgtatctccagtccttaatcacagtacgaacaagactggtgtacaggattgtgtacattgcacccttgatccggtcatggtccacggcgttaagagcttcgcggaacccttccaagatggttgggatcaccaggggtttgccgccaattaacgatctcagggatgagtcctgggagctttgtgcgactcgtcgaacatcggcgtatgatgacaagcaagattgggcaagatcaaggagcaggcgcttatcaatatcgctcttttgtcttgctgatgcattgtgcttcatacggagcatctggtaggcctcggcccgcttaacgaggagcggtcggggatatacctttcgcagacctttgatttggaatggggatatatcggacctgtagagtctaacatgacgatccagagggtgggctgatctttcgatgcccacatctgtgatccaggtacggtaggcgctgtacagtgcagtgaagcagtctacatcatcctccatgttctctctcaaaaagccatggaacttagacaggaggagaccaaggtcatcccggatattatgaatcttttggtaagatgcgtcgctagaagtgagcgcatatccggccctggcgcgaaattggggtcggagctcttcatcctctccaacctcggccagtggctcgtcatcgtcaatcaaatcttcctcgcctccatctatctccatcttcgatgtgccattggcctcgccatctcggtctccagaagcacgcttcgggtcaaacaaagtcgccataccggctgtgatgagacggatttgttgaagctgtctggacgcttcgtcagaccactccttgttctttcctgatctgctaactggcgggttgtcgctcattagcaactccaattgctcagtagctgactttgtctgggattcgaacagctcgacagcaaattcaatctcggatggagagggctggtgccaacgaattgtaaggtcagctggggttgtagatcggccccaatcggaaatatcaacgcctcgctgaatgacttctggctcgtacagggcatggtcaatcgcataggtgtgtgtcaggttgaggaggagatgatgaatgtagttggacaccaagatggtaggcaagccgcggcacttttctaacatgtactcggcaataccgagaagctccgatttgtagttgagaacttctcgtcccacatggacaacagtcatagcaagcatactgatatgccagaccaatgctcgatctctcggtaaataatctgtgccagatgttcggtctgacgcagcattgttctggtcgatctcgttacgaatattgacgacaagcatcggaacgaagaccttcagtgtcttctctgggttgatcttgcacagcgcattcaagatccaggccattgcatcacgagcctgatggatcacatggctagacacaaaagtagccagtttctcaagggcgatatcgaataattccggagagagtgatgcgaacagtggtgagaaagcagcaggaagtgcattgataacattgtcttctggtgtggcccctcgaacatcgttggcatcaggcaagttctccagaagggtgaagactttccctaatagagttatgagaaattcaccaaatccagctgtcgaggatctaaggatttgctcctcgtcctcatctgttagctctgtattgtagtcaatcttgacattctggccatcgcgctccatgcgctccatttcgccttggacccactgcatagccaaggtggtatcatggacgtcgccctcctccttggtaagtggaaccattggaatgctgttcgcaacactctgaatgaaagccagtgtatattgagttttacttagatcatttgcgtcaattccaggcagtgccagggcgaggagggcggtcaagtggcagcggtatcccttgagtcttgacatgacattggcaatcatctgcaatccattcaaactcgaagtggttcggtgcacctctaccaaaccctgaagactgggataaaatcgctggagcgcacctgggagcatcagatcaggctccaagaatgccaatccctgcagggcattgtagtaatagtgcgagactttcccgctcttggaaaacagacccataaaggtcacttccttgagtgaagccacaaaccgtctcttcagggcggcattgatccttctctcaggtggaatatcaagctctccgctctgctcgcggttccaacgggaaacgaaggaatccgtaagatagagcgtgagttggcctagcaatgcagtccaggagccctggttcgaggggtggaaaaatgtatcaatcgattccataagaccctctaagctagccatcgtagattcttcgtgttccaggcacaggggtgacagggagtacacaattagacgggagagcatgtacgcaattggatacttctttttgtctttctcaaggaacacggcagccccagacagataatctagggcagtatatggtgaactggcctggccaacgggaatgcctgtcaagcgaaggatggcggtgaaaatgagattggattgctccttggtgaaaatgccatactcattgaagggcacgtaggagcagtgcaggtgatccctagccattctagaaaacaaatctatcacaaaagtgtcgaataccttagatcggttcaagatcgaccacagatggaacagagtagggaagaaggtgccgggctgcgacttgacatcatgctctggggcaggttgactgggcaagagggcatttagcaacccaatgacgatgaaggcattgggcagatcgttgacactgaagtacggcaagaacacctccagcatctcgcgacgctcacttgggtcaaagaatgtatttgcgtgtgtgcacagcttgagcagctgcttcatcgagcgtcggcggctggtctgatggggtggggcttcggaggacagtatccatggcctgagctcttcccagaggggtcgccaatcgaacgtgaggtcctctccaggtttgaggtagtggctcttcctatttcggcgaccagttagtatagaattccgtttgagaggtggtgcaataggctcgagacaataacgaaccttgtgagtgtgagcaccatccgcaagaaacggtcagaagcagcatggtccaatccaggtgcaagtgcaagactaaagtataacttggcaagcttggccctgtcttctctcgtcatttcaaacttgaggtttagccatgctgacagctcccttgtccagtgcaaagcgcctgggttgaagtcctcagccttgatggcaatgtagagctgttttaggatctgctgcagagcagcatctcgttcggattcgtcttcgacctcgaacggcaactgcctgaagtaggcaaaggttcggggccgatatcgcttcttatcgtcatcgtctactttggcgcagggtatgccgggagtagtcgcacgggagatgggttcgtacggtgtgaagttggcgaagaggtgggcggcggtcgaggccgagagagcgccagcatggtccccgcggcgagggccaggattgtcatccatagcgacgaggtcgatggccgtgtcgatggccgcacactaatgtgagacggggacaacgggaggcctattccaacgtggcagttgggggggtttctcgagagaagctccagtattaatcgatagtcgtggtcatcagctgcctggggtggacggctcacgggcgggatatgctgattgatggctttcttatatctgtcgatgctgtcgtcggcgccgtccaaagaatgcgggtgtggatggtctgacacagtcggagctcagctacgacgcaaacatgcatgaatcaagaccaggataggagatgcaagatccagtcgaggcccattggatatgcagagggccgggtttggcgagtgttgtcaactgacaaagagataccggtttgatgagacagcgccgcaccattcaagtatctggagccttgtgcaggagacgatggacgcgggagggggggtgcgatggacaaaagaacaaatgtggatgctagacggtgatgatgaccacaggtggtagcctgaagagaggaagggtgggtgaggacccccaaagtacgcagctgtccactcctcagcgtctacgactgctgtactgcctctgccgcaccaccgcccgcgggtctagaaaaattccggggagctctcacgcaacggtggggcatcctcccgccacaacggaccccccaagctgtggcctcccaacgtcaggtcaagctttaggtctatcctgcgctgtagctaaggcgcctatccactgtaaacgcgaacgagttccagtcattctgcaagccgttgcggcagcctgcgaactgagccagcatatccatcgtggccctcctgcagtaggagtactgcgtttgatgcagccctcgcaacccagttcccgcatatctctggaattggggatacccatgcgcccgataaattgagtccttctaggcccatcaactaataataccatcgcacgtaactaacccagttcgtcattactggtcgacatccataacgaatcctttaattcatacccctcctaccataaacagctatcatgtgaaagtcgcagcagccagttagcatgatgatcgcctgcccgtgaatcaggaatgcctcttaatcgcttgccatgaagctatatcagacccaagctttccagaagcttctctgtacgctcacgagccttcaattcccaatagcacctctgatatcccctccaaagaacaacaaatccacccacactcgctcactcccacgaccaggcagtgatgactcgcataatcccaggggccctggtgacgtcgacagctgtcacctaatctgccattgcaattccaacgtacgcgcgccataatgccgatgaatcgaatcaggcgccgcgaagcccgtcgatatccttcctcgcccttccaccagcatgcaaataatggacgcccagctgttggtcgcgcaacttgtttttgtcacacgacacgaccccgcagacaagtagctgagtcgtcgataacgacgcaccaacacagattggattggcccagtcggatgacacccgctgaccagaagtgctggcaacactcagctcgacgcgagctgcgtgatatctcaacgcatgcgtctcgcccatcgctggcagagctcggcagatcccacgcctccagcaaatgcagagctagttttcctgcctacataaattcagggtttgaatgacacgccttgatgttccggtttggggaagccccactctgccgctcccgcctggcccgcattccgagtttccgacacactagcaggctcagttgtcgagatgcgtgcggcggagggggaggggattcgcgtcaccgaggggaagagggcctatttatctcagatggctaaatatagatatatttgtagataatagatagatacatgattaggtatttaaagtttttttcttcctttcatctggggctcattgaatgatggcccttcatcaacagttgctaggcttggtctatgatacatgaatgtttataggtatatgaataaggaaattcgttacttgcttccaaaacggttgctgattgaaatccgcctgattcgctgcgttattcgcctcaccacaaggcggcatgtatttgatttgtcctctgttgggacaagtggtgtgctgtacggttcgtatgtcgccaccttgggcgtcgtgggatatgttggggggacgggggctgtgtaagtactcgccgcatatgtgcttgctgtaaaagtacttgctgcatccatctcaaaattgggtttttcgctgaggtccagagacagtcgtcttttgcgcataaaagctgcgcccgcagacaaccgtctctggagacctggtttctctggagcctggccagccacgaccccgtcggtgaacattcgctggaccaccggtggtcgtgaaacaaggcctgccgttgaaatttcaggtagggtgttggagcggcgatggtctgtgttgttgctgctgacgctggatgacctgcaccttggcatggctcgtctgattcgcgagtgcgttgattcaggccagccttcctgtcgcagactaatccagctagcagtgaccatcataagccgcttgtgctctccgggaacaggtacggtcatccgctcatctgccggtggtgtcattgaacgcaagatgcgctctttcctggcgacatcaaaagacttggttggggggcttcgcccgctagatgaggacaaagtgcagtacgtgtgataaatctccagctcattcttcgttaatacaccaaggataggatggcgtcttgtcgaagggtcgatcacactgaaagtccacttatactccgggggagctgggcttggtgaaggagaagcgtccatgtagtccgaagacttcatctttggccgagcttcccgcttgacccagcgtgcggccgtcactcgcccttgattatccaccgatctgaactcatatgatccgttgcttagcagactcgttgcccacgctgtgccatcttccaaaacaatttcagcgccgtcatcaccccgctctgggagaggggaaacaacagcaatgatatctctgttgtccagctgatggtcctcgtcggggtccaagttcaccgatggcgagttatagtcttcactccggagaaataaaatatcatcgggccccagctcggctttggcgcggaagattcggggaaatcgtttggcgagcctggggatgatgatggagccagagacgatgctggaggggaccacctcaaaggctgggactggtcgttgttcgttgagcctttggagctggagaagcactcgtgggcggatctggaccagtgtccctcgtcgtgttcgggggtgaggagcgggatgggccaatgcgaagcggctcgagtcgcccggtagcctcttctgtctccttcttctgctgctcgtgatgctgcggtcagatccagcaacggactcgtcgtcatccgtcagagtaggagctggagacggtgctgtgtccacaggaggatccaggaacctgacggagagttctcttctgggtgttgttacttccgatagctgacgtcggcgggcaggtactaaagtctgcgggctgtcatcggacagagatcgccgcccagaggacgaggacgaggaagaagaagagacttctagtggtttgggttcggggaattcgacagttaggggtcgtaatgcggaacgaagcagaggaaatcgtctcggttgagcctgagatgtctgttggcctgagaattcgtggccatggaggcctgcaccggcgtggaggaacattgtggtcgtatatggtgttttgccagccacgatgggatgatatgtgggcaaatttgcgatggcgcgcaccaagaggatcggtctgggaatttgttggggaggggagcgaagtattattatagaccgatatcacggcctcattgagtgtataccagtagcaggccctggtataacccccagttcaggcgtctgtacgaaggtaaatatcgagaggtgggaatggcggtaagctggtggtccctgggtgtaggcggaaggtaacggagcgtgctggccgtcaagcttcagaccacttcagaccaagcaactgcagggtcgattggttcacaaatgcggaaagagaggaagcgaaaacggtgcgattttatgaaccttgcccgggcgccctgtagctttcaaaaggcgcctggtaaaagaaagggcatttgtctgaggctgggcccgtagttggaaaagtgccttgagacacacaatctggagttcggcacggtgggctctaaatcggtcggtaagtgagtgacgaccagggcgggcatagcaccatgttgtacaacaaacaccctcaggtgagcgacggccagtatcttacgagatctcaaatcccgcggtgtgcacaggcagtaaattccaggcactggccagcgccacgatgttgaagttgcggtctcgagactagggccagggacatctgcatccattctacgggggctgcaggcgagctgaacccggccgcctggagccgtcgtactcggatctcagtgggcgagaagggggcccaacccatggtcgtatgatagatacgtaattttcagggcgctcagataatctgcctaccttacccatctcacccagtacgagtacgaaaggcaggggttctccatcctcgcggcggtaaggaatagcagcgctaccacggcatgcgtgccacatctcaaaggggatggcgatcacacggtctgacccagtaaaggggggctccggcttgaattattagagcatagtggatgaaactagcctcatatccgcgaatagcagcccaccaagtcatcaatcctgccaatgagttgcaggatccgattaagacagagcaacacgaatacaagaaatgatttacaccgtggctctgggtctgcaaaacaggtcaaagttaatgaaacagtccacttagcattgtctttatttctttttcattattatttccttctcgctgtagtctttttttccttcctgcttcggcagccccgtgaccctggcctatagtaccatctcaacccacccaccatcttatgctgtggctggccagccttacgcacgaaaatatcaaaaatttcaacatcgccgttgagtcaggaacccagcaggtaatttccctaaatctcaggggcttttctgactgttcatgccaacttcttgacatctcgcgtctactagagcttccggctctgccgccctacgctggagttcatatgaccagtggtccccgagcattccgagcacgcgacaacgctggcgccaaaatgcttatgctataaaaagggatccgcggagcatcacatcggtctcgggcttctttgcttgccgaccttagataatccagcaccgagagatgcggaattcgggcggcaatctttgctagcgcgttgctcccttgccccagtgtaaaactcccgttttatgacatccacctgatactaacaacctccgtatgggccaaacgagaaacaagcagcctggcaagaatgtttgtcactgtatcgcaattgaccaggacccagaattgatttattggggaaaaaataatcaatatattttgcaagatgcaatacatccattgatttctaaatatctcaactttccaatacacatcacaaggttcagaaacatcatcgtaaaaaagtagctaaattcgtcactgattaagattgaggattatcttttaaatgataatcacatcaatcgttttcagaataaaaggtagataatacaaaatggttgacactatcaaagttcaatttgctctgtagacaggcttggtggtcctagtatcttagtcatcactatacccaacttttcgctctttgacaattatcaacgacaaccaaaacgacaacgtcatgaaatagaacaatatcatgtgctcacagccgacccattgcacaatgctgtgattttcaattgcttagttcaaccaggttccggagttcttaacaatctacatctcgaattgatacacattagccatgcgccgagtcagtgatccaaggctccatcaaccattcatctcgtagcagcaaccgacacaccatcacccaacatgcgcgagggacgccaggttttcgtggcagcgaagaactcccggcatcgtattgcggctctatctctctaccgggcgctcatccgaacctcacaaaagattgccataccgcaagagctcagcaaacatgcgcgaacccatcccgttgctcacctggtgagaaaacgctttgcgaatcatgtcaaatacacgagctttagacttgtatactcggctatggctacaggctacagggtaccttacagttgatccccgtctttgtatttgtgtggtcttctcatgacaaccgctaaccttcgtgcttcaagttcctaactgtattgacgaaagcccaaaccacgggatcttccgagcattccaaagtgcttgccattctcgccgaacgagcttcaaaagcagatcaatctcgaaaattaagatcatctcgagcaaacccgaaaacgaggaacccaaaatcccatgtcccactcttgcgccaggtcgctggccctggccagccgccagcatatgtcccgaaccccagacccgagggggagacgaagccaggacgaccccccgtgttggctgcagattgtttcgaaatcccattcctacgattcacgaaaccacaaccgcccgtgcttgggcagataataaataggagacgtttcctatggaggaggaggatagaagggattgaggtgtcagagaaaaaaatccctcaggctgtactagaggatgaatgggattcactggttgaagaccagatagcgcgcgagacgaagacacagcctcacactccacagcgccgcgaaacctttcaatggagcgttttcgtgggtaaattatggtacgagctttccctggagaagctctacgatgactgggtggcccgaggccaggcattccatcagatcgtggagcgcgagcatgctgagcgcgctggccgtggcaaggatacgctagtgaatcccataagcgtaatgaaatcagaggcggacgccttggccgagcaggaaacgagatccgagagattcgcggccatgcctgccttgggggcttggcatcgagcgagggagaagctcggagcggccgctgatccggtgcaaggaaatgagaacgacacgttcatctcacctgcatgggccgaagcgattgagttgcaagagtatcggctgatcaggtggatggacggagacaaatcagatcatactggtagcaaagcagtacgcgagtacagtgcatccagggatagggatacaacaagaccgcacagacgaggtccggcatgagctatgatatactctactaatgaaatgaaatttgtactatatcatgtaaatgtactatatcatgtaaatgtactatatcatgtaaatggacaacgaatgtcacatttcaaagactaccaatcttcggtgtctttccaagctctggcccttgctggacggttgagaatatatgagaggaacggaacatgacggaaccagtgcctctcttctcctcccgtctcttcacacaacgagcatcaaagcgagcactcaagccatcgaggagggaacgcgactaacggcagtatgggtgggtaagtgggatcacatggacaattggaaaaagcaataatgaatgaaaacctatagaccgcttattctccgttgctcgtatatgtcgcagaagagtggcgcactcacgactgtaggcagccgaggatttagatggcttacacctgcatatgtggctggacgccatctcagctacgatggagaaaggagaaagatgatcaaatcagaggtcacctgtgcaaaccgaatggatcgccatatgctccatattggtttttatattggcgttcagcccaaagctccacgcattgcaaacggcgcagcagatggtgggatgaagtgcaagacctgcatggggcccagatccttccatcggtgagtgatgtcatgttgagcatcggtatcgagtgtggtataggaaaattctaaaataaaacaagtggttacaaatcaatactatgtagaagaattataacccgctggctgacaacggctctccgtcaacagcttcgcgaacaacacgcaagccttgatattcaccaaagatggctaaaaaaaaacagagtcgaaattaggctctgtttaggcacaactgtgtggaagctaagacctggcgatcaggccccgctattcgattggcatgtgccaaggctacccggagtgggaggtaatgttccgacatggttgtgccaacacagtcttgagatgacaatttctgatttatgatggattagtagtctgaaatcatctagattttcacaaccagaccgcgtgcgtctttcaccataatgaaacagtgagagagtaatttttcattaccgatcataggtcgctaggggggaggagacgccaaacagcaacgggagctaataaagcgggtgggcgagaacagcccgttagaacctaaatttacctatgcccggttgattgtgccagcgggcgcgattcgttggtcgaagagagcagaatacgttcgacaagacaccggcagccgacaaccgaaattgtctcgcgcaaccaacggcagaggtggcttgcagagtgaaacaatgcttcccaagagaggttgctgcatggctccaaccagatccattgtttttggcgcacgagaaaaagaaagcagaattggaactttggattccttgcactcagcacgcctaattccgtcatccaactggccagatcgagaggacccctgtccagtccagcgatcttggatctcggtatttctgatcgtccaataagctcatgaggcaccctgcaagtagttttcttgctccgtaagactcggatggtcagcaagttgactggtggtgtaatgacgatgcgatgaggctgtttggttcccgtctcactcatcagttcatccactttcagtctattcgcttgataggggcagcctactattgatacttgaacgccctagccgttggataattttgagaccgtaccgcgtaaccaagacaagcttgaggcttgcgtcgactcgcatacacgtatgtagagatcgcaatgattccatttctgccaccatcgccttgggatggaaggcggcaggtggcaatttagacgtagccagaggatgtacaaagaaattggtatttgctagcaatttcaagcatctgcacagtatatctcaacactcccgtgtgcaagtgatttggtgctgctggtcgtactggtcggattttggttgagagccggggcgttcctccaccacgatcgaacagtaaaggagcaaggactcgtcgaaggagatcatagcgagagactccatcgactatgctagatccaccctcgttcctttttattcacagcgatcctagcctcgtgtatgtagaccaccaagtgcaactacctatccgtctcccttcccgtgctcagccagtttgagtcagccaaatcgagtccgaagatattcggtgtacctgatgtcacttttgcccacccgggaatttttaaaccggccgttggtcctggtgttagcagaaacggtctgatctacaatgtccgtccgctcaaggtctctcaatatccatctcttagtcgtactcagtggcccgtccggagcttccagaacctcaattctgcccttgaatatcaaaaacgattcctcggctgaacccagaccgctgcctgcatgccgatgacggcgaatggcaatcccgcaaccctgccgcacggttgccgtccctcatggcatggtccagggcgtaaagaccaccacacggcgtacacggtcactgcctcccaggcatagactccagccgcctcttctgctgctgtccgcccagctcgggtgcggtctagaagggagagctggtatcaaagcagaggacggccgagaagaagctcgtcgaccatgtcggcagctcgcgatggcgccggccgggctgattggccccagcaggcgagccagggccaccaggaccaagatgagaatagccacagccacacgagtcttagcagtccttgtgggggtcagtcccagtctaggctcagtctgctgccactgccgacttgcagcccgcgctccgttgcccagaccaatttccaacttgatcatcctcaaatacacgacttctttcacgccccgtgtccccagctgctgcagccatccgacctctttctccctcccccgttctctgttgacactaacttgtttggcctgccggatagccagctgctccccgatcgatacacgttcgagcttggatctcagatcttcccgcaagaccccgcaggcgctgcaaccaccaacattaactgcgttagcgctactgagctgcctccaccagcggatgcgagtttcttccccaccgccgtcccgcagaccttccagcaaccgcttcttctctcccaggacgagaccctagccagatcgtcccaaggcagaggtctgggagtagctccggctattgatccgaccccgacggactcgttgcgtagttggccccaacccccattgcttccccgatcaaccgtcgttgactggcctgtgccgcttgctctcaggtctgacaaaccgcaggcgccgccccccatgcccaggaatgcagcttcggctgatcgccgccaggacaaggcaggcccatctacagacacaacctcggcagcgccgacgaaatcatcccggggccctcccaaagcgactcggaagcgggcgagagtggaggatgctgacgaggcagacgccgccgaggccggtgagcagtctcctgacccagccagagatgctgagccatcgggccagagaaagaagacccgtggccggccccgtaaagtaacttcgggagacgtcggccacagtgaggcgagtctcccccccccccctcccttgaccagctccaggtgtttccccaggccgtggttcagggcactaatagtccgagcagcggcgacgccagcaaatccgcgaggcacagcgtgcctaccgcgcgcgcaaggattcggcgatcacggacttggaggataagctcctcaaggcccacgagaagatgaacaacatggccgacgagttctcgaagttcatcgatttcgcaaacaccaagggcgcgctggccagcaacaacgtcgaggtctcgctgcgcttgcaggatatcagcagcaaattccaaacaatagcttccgagagcgccagcgcaggcgccggccacccgcaagctgtagatccgtccggttcaagtgtaatgagcaatggcaccgacggcaacggccacagacgcattctgcccctgctcaggccaaatgactcggcccacagctcgtctcccagcttcgtcgaggtgacccaagctctgcaggtcgactcctcctatgagattcttgctcatcccacgcttagcaatgccagcttccccgactacgaccccagcgcgctgacgcccgaggattttgacctcgatgaagaagtcccagttgcaaccgcttcatgttacatggaagcaataggcccaggtctgcaggctccagtctcgtatgcccaccaggagctaactttcggtcgccgtctgcagcgcaacaccctcgaacgtggtttgagacttgtatcaatggagtctccacctccggctaggtattacggcgtgtttggattctgtcttctctttgaatctcgcaaatcgattgcctggcgtctagaggacaggctcatggctgcccggggcgaatctctcaactactggagggcccctttcacaaacctaggcggcgcgggatggcactaccccaatgcaaccagccattccgattcctcgagtaggtcgccattcgatgctccttatggcaaccagggcacctttgaagcccaccggcctcagcataacacagggtattccatgggaccttggtgggattcagtaatagagacagccgagtgtcgcatgggccggaagatgcaactcatatttcccggcttcgcaggtgaatttttagacacaggtgagattgagatttacatgcgtgaccgaggcatctacatccccggcaacgcagattatgtgaaggcccaggtcgacctggatgacttcaacggcgcagtcgatatctttgctcacaacaagccccgcgacaccggccccaggttgatcagcggtcccaacacgggcccgcccttattcagagacggttcagcaccaggagccccggacaccaacagcatctttccgtacatatgcccagccatcccgacgcaacggcctccgccgccaccgccctcccgcaagatgaccgtagatatagacgtcaccgtcttggcagaaggtatgcttgcaactcacatctcccgttcatcaatggagcttacatgttgtagaaatatgtagccacgccgtatgcctgggccgaacgcccgcgatacggccggaggacctcgacaaagctctcgacaaggcaatgtttaaccggataccaacctataatccattcatgccttttcctcaaatgcgataacccacgagcgagtctgacacgaatccgaattacgcaatcttatttaagccccacggtcttcaaagctctgggcaaaatgcctcccccggcgtacttaggaatgaataaagatatgtctatgagcatctcctgtgctatttatgtaaatttaatgtgttcatactctgggaacaggggtttcctttctgtctcgttaaatatgtaaaatacctagatttgaaagaagataggagatattgtacataacttgaacccctcaatgagacctaactggctctgaagctttatcaatttggaagggatgctggagatctccttgatcggagtgaggggttgcccaccaagtgacatcctaacctgtggcacaccaagccttcgacattgaattccgcataaaagcaacaatcaccataagaatcatgaataaattgttaaactattatcctagtatagtttattgtctgctcgttatcatccttataattttatcaagttctgtgatagactaagcggggggtgcaaccttctatgccgccatttgctatagataagtggtgtgagattgccgagaccgctgcatcaacttcgctgtcttatctttaacagcattccctctttccacatcacataacgacctacctacaccacttcatttcatttgcgaggacccgtcaattttaaccgcccaagatggagctcaagcaaaatctcccaagtcccagcccaaagctgaagccgcggctgatcatccacggaggcgcaggcaacgtccaacgagacaccttcacccctgagaaatatgaactgtaccgcacaaccctcctctccatcgtgtccaagacggcagcgtacatggacggcgtagcaagcgacggcaagcggcggccccgcccgtccgccctggagatcgccacccacgccgttgtccagctcgaggacagcccgctgttcaacagcgggcacggcgccgtcttcacccgcgacgggatcaacgagctcgaggcctcggtcatggtctcccacggccgggcgaagcgcggcgtgggcgtcatgggcctgcggcgtgtgcgcaaccccatcctgctcgcccggcgcatgctggaggaaggggacaaggaccttgcgccgaagatgtcttcttcttctaacttcatgacgacgggtgaagggggtgatcttgatgtcccgtctgctcagggccatacgcagatttatggcgagacggcggagcagctggcgaggcagtatgggcttgatatcgtggacacgagttactttttcacgcagcagcgttgggatgagcatatcagggcgctcgagcaagagaagcttggaagaggcggtgctacgtgggcggtggacgagtatctgccacaagggacatgcggcgcagttgcgatggatgaggatggcgtcgtgtgcgccgcgacgagcactggcgggttgactaacaagctgaccgggagagtgggtgacactcccgtgccgggcgcaggattctgggccgaggagtgggaagaggaaggggtgccgtcttccttatgggacatgtcgaaagcagcggttgcatcttatggtttgccgctcttcggtctatcggactcgctgagggggctcgttgcagattgtcttcccaccccctttctatacagcccagtctcttcaatattgcctgcaacaggaacgataaccacaagatccatgggtgtatccggtaccggcaacggtgattcattcctacgaacgaacgcagcgcggaccgttgccgccatggctcgtttcaaaccagagtcgactgcgaaagcgcttgccaatgtcgccggtacaggaggcgagctccagcgcagcgcgggatctcgatttgggaaaaccggtgagggtgagggcgggatgattgccattgagtctgtcatctctcgagatagccaggggacgatcgtagacgccagtgcagaggtcttgatggatttcaactgtgctggaatgtttagagcatggattggcgacgatgggaagcctgtgatgagcatatggagtagaggagctgaagacgggtttcattaaacgacacctccaatgccagttaatcaaatacgcaatttactgccttgagatctcactagagttgtgtcaggccaatactctagtctacagtagaacactttagaaactgggtaggagtttgagaaacctcgacttttcatctcacatgtctaattctttcgtatgcggttgttttaattaactaaggttatttctctatgatgttgtcatgccctgggtagaagctatgactctgttcaaccctccaccgctcaatggaagtattaaagtttttttttctaacgatatcgtcctacaaacagcgatccgttgacgagcgctatcccaatcaagggtacaacgatagacgacacgagggtagcaatacagtgaggcgaaatggaatgtctagggtaccccctcggacttttacagactcagcccagctacttaatctgttagtggaacaagctttaaaagattgggtagatgtatgggaaaaggagtatggcatgagtatgcccactattgccttagtactcaaggctgagctgccacatcaagccgccatcaaattgagcctcccgtgaggtcgaagacgtatcatctttgacgagttcgacgaagtcatgctctcactaagacccaaagcccattaatcgtttgatgaactggccggcatgagagaaaacaatcgcttagttcgcttgaagaaccataaggctcctactttggataagatatacacaataattcaacattttggtacattccccagtttgggcgctgagaatcaatgatcaaaggataccacaccgctagttgctggttccgaccagaagccttcggtttctcttaataacctggttcaagcccttctccagcttctccgtttccttcctcgctgctataagtgcgccctccgcatcctccacgctcatcaaaggcatgccactcacaccggcattaccaaacttggccgctccatcctcagtggggtgatgaagaactgtcgagggggtactgaaatccttgccgtctggtgcgctgtagataccaacgccggcagcagcatcaggaccatagaaatacggggccaaggagttgaggcttgccgctgcagcatcttgccgcaaggttgcgccttttggccacccgacattggtgggacccaggttgagccttggaaggacgtactggttgatgtagctgagggcatcctctcgctggagctttccgatcgggtcttgtgtctggggttgggatgtggcagggaagatgttcgggcgtccattgggaacagccctccccttgatgagcgagaacgcgccgcttccaggctggtgccgagctgcaacaaaagcgccaggatgctcggcatgaccggcaatggaattctgcagatcaaggaacgtgttctcttcttcaacagtcaacccgcgaacgcaatccccattgggcgtaatcagcattctgctaccatcgacgtggaattgcttgcgcacaggctttccggctcgcaatgctgtgaggtcagagtcctgaatctcaccacacttgcaagcggtgtccttgcaacgggtggcccggtcctcagttgatgccggagacacagtgctgtcactatgcttgctacccgagttgctggaggtgctctgctccgccctggaggaagtagatgtcactggctttagcatgtgaagtttatcggcggtggccgtccagaggctgtctttaatgtcaataaagatagaaaacggcccgagctgcggtttctcctccttatcgccctcctcgacctcgccgccctctgaaacgggggttggctctgcagtaagagtcttgttgtcgtcctcgatttttacgggggatggctttggagcacgttcaaccgccttgaccttgttctcgattttgcgttcgctgctggtaggctctggcggagcctgcggttcctgtttgctaggagctggtggagcaacagcgtcttcagcggctttcaccggcgcgggcttctcctcttctgcaagcttcgtatcagacccccctgccgtttcttggagctgaggaacgactgcctttcgcgccttttccttcttctgctttttctttcgacccaggaccggagcatgttcctctagctcaggcttcggagcctcggcgatcgcctttgtatcttgcttgagggcgtcctttcgttgtttgcgttgttggctcttcgtggttgtacgcactgcagcagcgcctactctggatggtggaggagatccagctcgagacgcagacacggacgccgagacgatagaggctgtgtcactaaccatctcactaccaggagtgcccggtcgatgcgtcagggacagcgccctcgacacggcagaaattggcgaggccacagttgggacttccattttttggattgggagaagccgcagtgttttaggcgctcgtgtggcggagggggaggcattgcctgatgagggtattggaagaggtgggaaagcagtagattgagcgctcgacggcttctcgtgattgtcgcgagtatcaactttcttgagcgagggaggggaaggagtttcagccctcctgacgtccgctctagcaagcacgggcgattttggatccgggctactaagttgagtgttgatggttttgtcgagttgctgtttctttagagccggggtgcccttcggggttggaaccgctgggacagtagtcagggagggccgtccactggacttcctagacttgggagcattcaacgctgggaagtcttcttcctgaagagcagtgctgggcctagctgggtctgcttgggtctggcctgacgtgatctttgcgagcccactttcagcaaccaagcttcccgcaccctgctttgtctcagttgagcttggtgggagcacactatgaggcggttgttctggagtcaatagtccagcagacagaccaggtggtggtccggctgttatggaagccatagccatcgggaagcgaaactggctttgaaatgcatcgtatcctaggccgggagggcggtatcccatggggtcatcgaatccaggcggtacagacggaccgctggtgttctgtagggctgacccagactggatgatggtatcaaatgtgtcgtcggacaccaatgcatctaccgagctcgtagcttcatccagggatggtagatcgtcatctagaaatacccattagcccctaggttcattcagagtgtgtaagatgatgatagtgcgatgtgaaagaagcatagtgaggctacgatgcgttgacgccggttattatgtacaggaagaattcggcaggtcaagctacggctgccatcatcgtcttcgacaacaacaaaaatcaaggcaacccggagagaataaaagacagataggtatattctgaccaaagatgccaccgacctaggcggtgaatgcaaccagttaacgtacataacaggggtttgtggaagacgatgatggcttgcctgacttgacccttgaatactcctagacgtaaaaccaagcgccaagccaaagtagaaaaaagtcgacaaggctgactgttcctgtgggaacctgtttccaaatgcagagaagctgacgatttcgggtcaaatgcattgccctcgatgaacgagaaaaaagaaaaagaagaaaaccccagccctgaaaagacaaaaaaacaaccaaaaacaccgctcttatacatgaaatgaactctggcattcttgtgtgcctgaggttccgctatgcatcccgcctttctaaaatcatgttccatccctcatctaccatctggtatatccggcattatacatcatattgggattgtacccaccttggctctgaccaccaaacagtccatgtgcggctccggcattgctctgcggctggtgttgcatccttgcctgaaggatactcgggtccgcaagatcaactaagccactcccccccgaggaggaagtgttagcatgtctatgcttcttccccttcttcttctgcttggaaccaaaatcttggaacgccccgggctgagtgccatagagcgatagaaggccaggagcaggagctggggtagaggtagagggtgggtactgattagaaaaagaagagatcatgtactcacgctttccagtatcatgagcttgactgttggctccccgagtacgtccgattaaggtttgtaagaggtcgttggatgaatcttttggggtacctgcaaaggcagacccggcgaacccgctctgtccaaacatgtttgggggggttccagttgatttcagcccgggtggtggaccgggcatcgaggaagcataatattgattgccttgagattggaacgaatttggcatcattgatgattgttgcgccatgatgcgggggttcgctgacagcttaatattggtcacagaactaccgctctcgttggcaaagttaaagcgcgaggactgtcgattgtgaccctgggattggaagaggttggtctggttggagataccgggtggcatctgatcgttgaaaccaccctgggatcgcatgttgaaaatctgttgaggggtcatggttcgagtgacaggattggtggaagtctgaccaaatgccgaggcgcccaaggctggaccaaacggcccgtctgtatttgttcgctggatcggcggctgagttcctggccttctttgttcgaagcctaggctctcccccgacacttcacgctcctcaggttcacctcctaacgctaggctcccgccagcttctggttctccctcggactgttcaatagcttcaacctgctcttcctgttcgccattgattcgaagatcatcctcctctctcatggcccttcgtctctcacccccttgaatgtcaaacaagggaggatattgagagtcatcaagtagcgcatttcgaaagtcagggaacgggcattcgtgaaggatcttgatcaaagccttgagcgaggtttctggaacagatcgccaagactcttcggatggcttcttttggatttgcggctgaggactgggctcttgctgggttgccggctcaggatcctcaactgcttcctcttgaacttgaacctttgccgtggctactaaggcggcagacactgccggactcgatgcagcagcactggtagcatggcttccacgacgactccgctgtggatttcgagcccagttcgccgaagatggcaaggcagatgagtctaccccaccgtcagacccgtctttgctcacagatcgagccatggcttgagcggcaggttgcgcctgcggcggcggggtagggtgggaaagttgtcgagacgctactcgtgaggggccgctgcttcctccgccagggagtggcctctgggtatgtatgctgttcatagaggataagtcttgacgagtgtagctatcctcatcgtcgccttgctcgtgaaggaacatgcatccagggttattacacttctcgttcttcagccatgccgaacagtactttgtcgtcccatgctgagccttcaggtaccgatcgccgttctgtgagccgtggacggcttggatacactttgtggcttcttccggtttctcgaaggtcacgtagatgccgagtgactgatgttgcccatccgagctcttcctattgctaatggagattttctgaatgttgccatactgaccaaaaaattcaggtttccgtagtgttttgagcagttcatcttcccgcacagtcggcgctagacctgtgatgtacaccaggtttttctggactactcgcaccccaaccagatttttgcggttctccttctcggcttctcgcttttgggcctctttctgtcgctgctcctgggctcgcttcttctgatttttctggatgtttgcacggaactcggccaccctaaaattcagtcagcatgcaacgttgtcgtggtcgaaatatgttatgcatactcttctgttgtgacgactttgtattgtatcgttttctcatcgtaggggcgtcgacaagctgggcagaggccgttcatattatttttgatattattgaaacagaactggcaaacctgcgacagagttagtccaacatatgagcctgtaaaggttcctgcaaggattctgtacctgatatccacaaggacatggccggaaattccgatctgaaagatcgaaatcttctatgcagagagggcttttggctgttagcttcgtgttcctaatgctacccaacgaaaatggcgggagttgcaacgcgctcgacaaagtgtagctgcgcgacataccatgtatcgccctcttcctcgataaaagaatcttgaggtgccatgatttttgtggtatcaaaggggggtatgatgatgattaggtatgaagtgttggtagggagctgattaaagaaaagttaggatcgttaaggaacattcattactagcacaaaggccaggcaaggaaagcagatgtaaacgaagctagtctgttataggtctagccccagtctgctatcacatgacttagcgcgacagcttcgaaagtacatgtcggcaaatattcgggaatctcgtccaacggcgagagctgcatttcaatcagggctcctgctcccagacaacctcatcacgacctcggtgaaaccctcgaatcgacaattggccttagaacctgataatttcggtcatggcgagtagattgccccgaagcggggctttggcctcagctttacgacccgtgaaggcctcccggggcgaccaggccgtccgctgcctctccgtcagtgccgctcaatttgtcgcaattggcaaggactctccgaacatgcgaaaagccccccgcgaccatatcggaactctcaaagcgccaattgtcaacccagccgaccagtatcagagcaaggcagataacctccaccgctatggcgcgtggctgatgggttgccttcccaaatatgttcagcagttctcggtctggaaggacgagctcacgatctacatctcgccttcaggcgtcatcccggtgttttctttcctgaaatgttagtgctcaagaatgattcatttaggtgtgttaactaattttccgacttgaagacaacaccgctgccgagttcacacaagttagcgctgtcacagctgccgacttcccgactcgggacaaccgattcgaaattgtctacaaccttctttctgttcgccacaactctagaatccgagtcaagacatacgccgacgaggctactcccgtccctagcatcaccagcttgtttggcggtgccaattggtacgagcgtgaggtatatgacatgtttggtgtcttcttcgccggtcacccggatctccgccgcatcatgacagactatggctttgaaggccaccctctacgcaaggacttccctcttaccggttacaccgaggttcgctacgatgaggagaagaaacgtattgtcaccgaaccgttggaactcacccaggctttccgaaacttcgagggtggctctagtgtttgggaacaggttgggccgggtgaaacccggacacccgagtcgttcaaattgcccacaccaaagccagaggagaagaaggaggaggctaagaagtagactgttggaacagactgtgtatgacttatttgttagatataactcactgataagcctcagtgtacgttctttaaaaccaaaataacacggcatcatatttgtccctcgtactgcactgcatgaaatgaacttgtgccgtgccaaaaattgaaggcatggtttcattgcaaacctgctgctaagttccgcggactggagcggaaataccacttggttaattattggaaagcatagtgaagcccgaaaaaattgatgtttcttgggggtactgccagctattgcaatggagtacctatacaggcggagactcagaaactatcagggccacttgcgcgcatgttgaagtagaagcaggatcggagggaatatggctattaagttacagtgctaggattttccttgaactagagcatcgcgtctctcgttcgccgacataccttattatcgcctaaaaacctatacttgtacgaacactcgaatgaactatttgcattgctcagtgttcgacgggctgcctgatgaatccaagacaaggtatgcattaggacattacgtaggtgcaaaacagccgaagagcgtctccgattggttgcaagtagaccaggaatgcttgccgccaacaagggcaggacgcgagagacttcattttttactgctttctttttgtcttttctagggtacactggaatcatatgggggccttatgtatcctgcttgatgtccgcgtgaacactaggtaggtatcaagagcgtggtcatgaagataaatgtttcgtcccaaggtggaaaataatacgaggtaccttggcgcgcatgagttcaggtttcggactagacgtaactctttgggcccaacagcctgagtggtactgcaattaccggacccaaattaccacctgaagcaatggaggggcacttctcaacgcaagacttagcgcatgacagatacctcgatccgctgaagagagctgcacgtgactggagctaggcttgacagcaccaaaacctgcctgaagctggcatccttcgctaagagcgcgcgctaatgcggagcagccaattgtcacccttggcctcatccaggtaactcatctgacatccatatccacttggcgagcatacggacttatcacggcctcccagtatcgagagtcagcaaccgatatcgacattctacaaccatagactatcggcatccgactcgacgacgaccgccaacatctccctccgccgatctcgaggtctcttagcatctggaccatcaccatctccatgcgatcataggcgaagcaaacgacaaaaggaggtgttcgacctctcccttctcaacgatttcaacagcaggtgtgcgcccactttcctgtggtgacgctctgcccatgaacgggctgaaataacttcaccgtcgtatctaggagctgtaggactcagctgtctgtgaaggggaactgccagcgccttggcctcgtgaggctcgtcctcattttcgatgatggtgagtgatcctaatgatgtttcaacccgaccgggtagaaatgggaatgcgtttcggaccttttcgttttcctccaaatgctcttttatcgcagataacttgtctgccgaaacacctgttctgcggcatggtagttttccatgtagaatggacatcgaggctaacttgcggaattatacagacctcacctcggctcggcggtcaggttggcggcagcttcgccaatcggcgcggtcatgctagtcaactctccatctcggatcctagccatcatgttactgaggcgattggcacactctacggcgacgaagatgaatcaccgctggcggacaacatgaacagaccgttgagtttcattggcggctcgcctttctccgaacaaatccattttgtaccacaaaatagagatcttttgtcacccgatgcgtcgagacaaacaaatagggcggcgtcagagccaacatcgcccttgttcaacggcgaacgaggcagtctcaaaaagtcgcctccagcgatgctccagggtcagcaacgtaaaggctcttttgaaaatggtccaaaatcaccacgatcaccacctctgtctctccgagacgtgcaaacggatgcggctacctcccaatacacgctcacaaacatcgataatgcgaacgacattgcccaggaattaagtaatctacaagcactcaggcggatgtcaatggatgtggggaatatcaaagatccggacatgccgcagatgtctctctcgagcattcctctggttgcaccaactggtgatgatgatgaggccgatccttcacgtttactctgggtgcccgcgcgagttcacccggaactggcacccacggaattcaagtcatttcttgaaactcgagtccaatcgatacgtaggaagtcgagagatatgggattgggtgacggagatctcggccccagcaattcaggctcatcactaggcgtgggtcagtccctgaggcgacaaaagtcaaagctttcgaggcagattgtgaataatacaggccaaggtgcctcgggatatgttgatggcgctgaaagacttgaacgacaaagatcacaacgggaacggcagaactccgaactcagtttagaggaccttgtcaaggatccaaccaaggctgtgaaaaggctcgctcaagaatcccaggctgccagcgatggcgcggaaggcaaccctgatgataggcctattttgccaatgcctcccggcatgggtcttcgaagatctaccaggacccaataccgcaaaggtggaagtttacggggagaaaggcctttctcaagacgcgtagggcaccgtcaccaggagagcgaggactcgggaatccccccagttccagctccaccaggacacgcgattatgagagtacaaacagagcccatttccgaagaacagtcgagatcctcagctcgttcacctgagcttactcgagaatctgcggagtcctcaaatgcactcgacagcccctcgccaagagctgagcggccgccaacgcaggcgtcgtctcaagagtcacatgagccagcgaaatatgcttcagcttccgaatatagcccacgggcttctgaggctacggtggaacaagacaaagaaattggctcacctccccgagagggttcagtgcgctcaccaatcctagcacaagtagaacctgcccatgatcctattccttccgagttgccaccaaaatcgtctcgacgcaaactgagccagaatgcatctccttctcagcaatacacaaagccagcgcctaatgcttcacagaatttaaatgaacagattgcagggaactctaattcttatggcggaaacagctcctcaagaactgatagtctggctttcattcctaccttcaacagtcaggacgagaaaaagaagtcaaagaaggataaagatgatgattctgcgtcaaccaaatcaacaagcagcgcatggaaatggttcaagagcagcagtgaggacaaggagaagaagaaagaagaaggcaagaagtcgagaacaaaggcacttgttgagcgagcccaagataatgtacggctggatgtcatacagacgtcgatcgataagacggcgattaagggtcgcgagagcgtcgtattggatcgggatagtgtggatagcaaacttcaagatgatcggagaaaggatggccaccgaaagagtgacgggaaaaaggagaaggattccagcattttttcgtccatctttgggggcagcaagaagaaggaagagaaggacaggcacagcaagaagtcccagcatctccgagtcccgtccgagccccctgtcgtcaaacccttggaacccgatgtcgactatcactggactcggtttcccctcttggaggagcgggctatctatcgaatggcacatatcaaactggcaaaccctcgacgcccgctgttaagccaggtattgctcagcaacttcatgtacagctatttggcaatcgttcaagcgatgcatcccaacatgaacgtccccgtctccccccagcagaaacgtcttgaggaagaggccagacgaaaacgggaagaggaggagtatctggcccagcagcagatgcagacaggacaaaatgagcaagacctggaccagtacgactttgattatcatcgggtaagtgttttttttttgctcccctcattgacattagctaataaggtgaacagtctgccgtggcatacggtgaggccggggctagcgaagaggtggactacgttgatgacgctcaaatatatgaagatgagcacgggactgatcaccatcatcaacaaacccgtcaacaggactacggttatgagggtacagactcctacggtcacgaggtgaaggattattaccaatatcacgacaatgatcagcgtcgtgatggaagagacaataatatgtggtgactacatggtagtgatgacaacaataacaacaacaacaacgacggcgacaacaattggctctaaacccagcgcggattctgttctttttaggtttccaactatatacagccatttctggcgacggcggtcttggcaggccagtggcgaacttgtcgagatcgtatacggtgctttgataagcaaaatctacactaagcatttggcggagtttatttttggggtttgggcggtggtattcgggtgtatttgcaggtttatgttgagatcaacgatggtatcatagggactagcgacggagatggcgtgtggtttgaacacaagcgtgaggtacggctctgcaattattcgcatcttcagtcttcagtttatttcttggtttcttttagacgtcactacttgtcttgacacatattccccccatcaagttgtcaagatttctcacacgggattgcgactggacatgcatacgcgatgggcataacaatggtgtttgttccttactcccccgccgcgtcattctttttcggggaaaggaccggatagatatctgaaaaagactcggcatgagcccgagcctgggtcaccttgaatatatggtacgataggatgcccgacaaataataagcgtctgattctattgtgtgctgcagcttgggatgattcctggttcattgtctaaactttgccgcaaactctcgggagattgatcgcacaaggacacatatgccaaacgtttgttgaatgaaacggcttgctcttatcatagcagctagcactgcccaagcgtgcagagcggccatcttagtagccggcttgggggacagagccagcgcattcactctgctgactaataagcgagggtgaagtgcctgtgcgcactgatggtaactgaacagcttgttgttcctagacgctaagccattctaggtaaggctttgcgtcgcgacttcttgggctaatccagaaaattatctccaacctgccagccaagctagagcgcctttgagaagagtctgagatctgacttgcccttcctgccctctcacctcctgttttctttgatacccatcacgactcttcctaatcctcacttccgtctcctttctcctccctttggccgacaagagcctctgtcctctgccgtgtacgaaatctactgaaagcatggctgctgtgagtaattgattcatttctgcctcgagctcctttataatggccaccttcaatgtgtgctcgacattttcagccagccacgcattctgaaggacgcgtttgcttggcctctccgtcgaactcaatctgcggtccatatcgagaacttcattttaccatgcatttgcgtgcgtagcgttctgtcgcatggctccctcgcacccccctgcctccacatggaccgacaccaccatcttcttcgctccacggccatctacttttgactatgtcgctaacacccagcagccgcgatcgtacaacaatccaggctacctccagaacggcgcgagtggtctcccccctggtgctgcacccctcctgccgaaccagggtcgtgtcatccaaaccggtccaatccgagttctgtgtattgccgacgtacgaggtatggcatgaatgcgtctcatattttacgacggaaagcccgctgatcttttttgacaacaggaaatctgcggtctctcaacgatttagccaagcaagctcgagccgatcacattatccacaccggtgacttcgggttctacgatgatacatctctagagcgcattgccgagaagacgctaaagcatgttgctcaatactcgcctttaatctcggagcctgtcaagaaggctattcaacaaggtggtcccggtcccgtcaagagcagatttgctcccagcgagctcccactatccgaattatccttgctcctctctggagagctcaagcttgaggtgcccgtctacactgtttggggtgcctgcgaggatgtgcgagttcttgaaaaattccgatctgccgaatatcgggtaccaaatctgcacatcatcgatgaggctcgatcaatgcttcttgagatcggtggtgtgaagctacgacttctcggcctaggcggtgccgtggtaatgcacaagctgtttgacaatggagaaggccgcactactattgctggaggccagggaaccatgtggactacgcttcttcagatgggtgagcttattgatacagcgcacagggtctacgatcctaccgagactcgagttttcgtgacgcatgcctcccccgcccgtgagggcatcctgaaccagctctccgttaccctcaaggccgatttctccgtgtccgctggtctccatttccgctacggaagttcctacaacgagtttagtgtcaacccaacgctggatcattatcgaggcaagctcgctgcttctaaggcatctttcaacgatgtctgggatactgtcaagggggaggtcgagcctgctattcaacagaacgaggcccagcagaacttgctcaagaatgctcttcagattgtcgaaaagatgccttcaactgctgcgggaggcaacccctttggcggtccggtatctggaactggggctttgggtcaggttgacgagagcgcgttcaaaaatatgtggaacttcaatcttgccgatgctgcctttggatatcttgtgcttgagatccaggatggcagaatcggtaccgaaatgcgtgcccagggattcaacttctctcatcgaggcgtgaagcaacaggccggcgccccgcctgctgttccggcatcgacagcatcccccagcaacgctcctgcaccggctcctccctccacacaatcgtctgctccacccccagccagccgacaagcttcatcggcccagccacccaagcctgccgtcgctactcccttgactggtccccccaagtcgacaactcctcaccctccgggcagcgccaccaaggacgctgagaagacacctgcagcagccaatggatctaccaatggccaggagacagcgtcttcacccgcccctactaaatcaaccttttccgatatcatcggtcttttcattatgaatgtaaacagcgaggaacagtgccgtgatttgttcgccgaagaagacaaggccacgattgtcaagatcgagaaatggggcggcttgaatagccaaaataaggtggtccatttcaagaccgttgaagaacgtgatgctgctcttgcaagactgcccgaggacgtcaagacacgcacccaggaggatcgttcaaagcccctcgtcaagatcttccagcatcgcgaaagcaagaacttcagcaaccggggaggcgctggaaactggggaagcagcagccgtggcggtactactgctagcggctaccgaagcgctggcggcggtgcgagtgactcagagagcaatcgccgcggaggtcgaggcggccgaggtggtcgtggaggtgagagaggtcgtggcggccgtgggagaggtggtgtgaagggtgagactggcgcatcctcacctgctcctggtccagagtagtgctaaggacgtggacatgtgttgatgcttcgtccgaacgaactcatcctctttactcgattcatcgtgctcttttatccggcatctactcttttgcggggtgttgattcatttttcctttattcattcccctggtggtcattgcgctgggctcggaaggggggattaaaacttctaggctgagcttccagtttctgtgtatgtgtacttaatgagatgtcgaagccgtggcgctctgacattgaggtggctttgacttgcttggagtttagtgcgaagaggatagaataggtcctttgtgattgtggcacggggcctctgtgaatccactacatctcatacactcttttccatctgcagtgatttagtgatgccaacccgtcggtaacagagcctgcccacacagccgtcaacggctgtccgcagtgatcagcaccatcggttgctaggcaatacgtattccttctgacttgctacatacctgcctaggtagcgtgcttcccattaatcccacaagtcattcgtgaactttttctctccaaattcgaacaccgccatcatcgcatgccaacttcgatttcttcgacatttcattctctagagagcctgcccgaaatcaaggcataaaatccccactacaattccctccgaaatcgaggaattttatttcgtgattatgatctcaccggccgccagtctggctgtgattattctatgcctgttcatactcgtcgcacttgtttgttggtttttcaagtcccagatcagatcattcgtgcaagcacttgtgggccaccgccagaaagtccagcaaggagattccggtgattccagagtctaaattacatagggagggaccattttagtcgttctatctggagtcctgaggatgtgggtgaactacaaggctgatgaacacaaggatagtggtggcgccccactctgtcatgtcgcaaattctcggcctcagccttgtcaagaattccgacatcacgcaacaaatcagcttccacaccagtcaagctccaccaccggaacttcttcaatccctcccaaaatggcagtgcggcctacttcgaggatctatgggagtatctcaagatgctccatacgccccagtaccaacctcgcacgcccgttcagcacatcgcgtgtcgtcctcgcctccacccagacccctacgggcgatcggccgacgcactttggatatgagaccgttacagaatccgagaagcagcaacgtgttgcgggagtttttacgagcgtcgcagaatcatatgacaagatgaatgacttgatgtccctcggggttcataggctttggaagtacgcacaccgatcctttttcaccgtccaatggctcttgctaacatgtgtgaagggaccattttgtgtcctcattgaacccaggagcgactacccctatcggaacccctcagaccattcttgatgtcgctggcggcaccggtgatattgctttccggatgcagcagcacgcacaaaactacaaccgcaaccccaacgtaaagattatcgtctccgacatcaaccccgacatgctcgctgtcggccgccagcgatcccttgccctccctgctacacatcaggccaacctctccttcctggaggcgaatgctgaggttttgccgcccaagctcgaagataactcgctcgacctatacacagtgtcctttggtatccgaaatttctccaacattcctgcagctctacgggaggctcaccgcgttctgaagccaggcggtgtgtttgcctgcctcgagttctcaaaggtggacaagtacccgctgttcaacgccttttacaagcagtggtcgttcggcgcgatccctctgatcggccagctcgtggctggcgaccgtgacagctaccaatatctagtggaaagcattgagcgcttcccgagccaagaggacttccgtgatatgattgtggatgctggctttgaagttgctggcaaggggtacgaggacttgactggcggcattgcggctattcatcgcggtatcaaacccctttaagcactggggtagccatgtttcgttgtacaataaatgtaaattacttgaaagtaacgaatgatatagaccgaattctgacgctcatatcgaggcttccacgtgtagatgttatagaagctaccggctgctggtgacggcttatgataaattcctttactgaaaaaccgcgattgatgtaaagttaaaagcacccaatggatgttgccatcaattcctcggtgatccgacttttgtatatcacgaacctaccattgcccaccggggcaaaagagccaaaacttacttatgcttgcttggctcgtaatttggtttttattatctgtctagctaactcatgcttccaattgttgagttatcgagaaaattagcttcaagaaagccagggtgcccgtggttggaatccagcctaggtagagaattgaatgcagagaaggatagagagggctactgttccatcctagctcgattccctcgactgacaatactccagtagaacttaccctagttcgttaacctagaggagcaaatccggaggtgggcgcttatcgataagaaaatgcggaggtggggctcgtcactctcgtcattgtgaatgattgtctgagactcatcccgtcgggagtcaatcccttttcatctctgcagtacgtggcagaaataaggactgactgaggtaattagccgctataaattaagatccttaatttggcgggtatcggttgaaggttcagcgagttacgcccaggcacggcgatggtttgttgcggtctccctcggctcgctttctgtcggctcagctgactacctacttcacttgacgtactcggcgctgtgctaggccgtaccagcatctcggcaataacctacttctctgaggcgccactcgaaggatactttttgttgatctattcacctctggtatacaaatcagcttgtccacgtcgtcttattcgaattcgcccaagatacacacacttaaacgaccttcacaatgaaggctcgcgcgttacagagcgcctccctctgtcgagcggtcgcagcacgaaccctaccgacttccagcttctacagatcgattcgctcagcgagcagcatttcccagcgaccggaatcagactttgtatccttcccaggtgcactgaagagtgccttcaccaatactcttcagttccagcacccgcaagaatggacagccttgccaacctaccgagttgtcgatcaaaatggcactattgtcgacccgtcattcaagcctgatatccccgaggaaacaatcgtgaagctatatacagacatggtctatatctcaatattggatgtcatcatgtttgatgcacagcgacagggccgtctaagcttttacatggtcagcgctggagaagaagctgtccctgttggcagctccagtgtgctagacagagaagatgtcatcttctgccagtatcgcgaacagggatgcttccgtgagagaggcttcaccactaagcaatttatggcacagctatttgcaaacagggaagatagcgggagaggcagaaatatgcctatccactatggatgcaaagagttgaatattgtaagtcctcaactatcacgtataatctgatcgtgcatatctaggccctactaacaccatcacagcatactatctcatcgacaattggcacccagttaccacatgctgcaggcagtgcgtatgcccaaagaatggccaaacttcgagaccccagctccaaacctcttatcacagttgcttacctcggcgagggtgcagcaagcggtgctgatttccacgcagcgctcaacatcgccgcaactcgttcctgtccgataatctacatttgccgcaataacggttatgctatttccacccccactctggaccagtatcgcggtgacggcattgcaagccgaggaattggatatggcattgatacaatccgggtggatggcaacgacatttgggctgttcgggaggcagtcaagagagcccgacaaatcgccattgaggatggcggcaagcccgttttaatcgaggccctgacctaccgagtgtcccaccacagcacatctgatgattcattcgcataccgtgcacgggtagaggttgaggactggaagcgccgcgataaccccatcacgcggctcagaaagtggatggaaaacaacgggatgtgggacgatgccaaggagaaggaggccagagaccggttacgaaaggagattctcaagggtattagtgaggctgagaaggagaagaagccccccttgagctacatgttcgaggatacttatgagaacctgactccggacttgaagaagcagatgaagaagttgcgggaagtcatcgacaagtatccaaacgaatatgatgtggcagaatacgacggtggtaaggagagcctgaaaaaagattaaagtacgcaagacaacttagcaaacagatataaggtgaagcagagcaaagaagtttaataatacccaatttttaacaacagtagacgacagcgtacgaatatcattgcttgtaccaccataattaaatgaagcttccgggaggaaaaccgacctgtaagatatttctctgcacgatagcgtaccaagtatgctgcctgtaagcccgccacctacctacgacgactgtctgatagtgcatatggagtgtttgttatgccgtgccatcgtagcccaacgtggcatgcgggaagagaatgcctgacagaaagctggccaagtggtctcctgcaaaagcggtcaggggatacgggcttgtggatggatggcatggtcatacggccttggtttccatctgttggctgcattcggccatctcctcccaatgaatttgaatctagatagctaaccacaaaccttccggctggcactaaataattgaaaataaacaaacaaccaaaatcaacaaagaagttgggctgaaaaaaagatattgcgggaaatatgttgtagtgccagcaaggccatgggtaacacacagtattgaacgcggccgccaggtgagacatgagtagtactatgcctttcaaaatcccatgttctagtacagctcattgatcgcccttgctctaatttggcgttgcctcaaggtttgcaccagaaattgcccaaagggccttggcccatgatttctgggtttgcgttatcagtgggctctgtggaggacaaccccgccagctttgggtggctggcggctagagcttacctaccggtatccggctgatgacatatacacctcaaagttaggacagaagtagaccgtcttgggcgcttgggagagctgcgtggtgtatatggactcggtacatgtgcaaatgcagataccccgtccgagtgccatagtgtcatcggcacagagagaaacctacccttgctggtgggccgtcgggagatagtggatttagggaggctgaagctctaaagacgtcctggccttagtgcgaccggggggcgttgccttgcacaatacaagatgggacacacgccaccacttcccttatagcgggcatgccatgcacgtagtggcattaagcaggattacatactgtccagcgctgccaatgcagccaaagtcagcaccggcgcacgatcatctctttttacacattttctcttcccatatgtggcaccgataatccgccgaccgtcgctcaccatacagctgctgcatcccatacccacgacgatacccagacctccctgcgacccaggcagcgaagcgtgatctcaggcagcactgaggaccctctcgacatcaccgactctccccccgcaaaccacctccgaaagcgcaagacgcccaacgccgctccgtcccgtgcctgccctgcctctcccccgctgctggtcaacgtcgtgccttccctcctgatggcgtagtctgggcatggcagaacaaacatcggcagctgagaacgaagcgcgacttcccccccaggcgagaccagctgcagcgtctcccataggctctcaacggtaggtgaaccttgattcccgcgtttgcccaggtccaagttgcttctctcgctgcctgcctgctttacttgcgtcccatcccatcctaccagccctgatcatctatctctttctgccgcttaccttatgccgctgcccctgcgttacatacgtccacaccgcacgcagccttgggtcccggactgtctctcttccatccatccatccaacccagcaccacgccctctacccagcccacctccgacgttgatgttcgctcacatgcacctgtctggacgctattagctctgccagtctcccatccgattgactatgggccgaaaccctagctgttccatagtttgattcactacggtttatccaaggcacagggccctggttgcattcaccatcttttctcctgcctagcgggccacttttcttctctccttccttcctatctactgatacaagcctgtcgctatactctttgtcgtttttcttccctcttcactttttctcaacatttcttctccccttctctttccatcacaccccagccttgcacaacatcctgcgccatgtgcctgaggcttctagtgggatttgagtcttgagctttagacgtgtggttgtggtgatcacgcatccaagtgcagcctcatagcacatcctttcattgtctcattttctttaacagcctctgctttgcttcgtcggccgtgtctgttcgtggcctcgatacctcgttactcatgcctcccagaattactagatcatctgctcgccaagcagccagccaggtagcgcgtccctcgggtgcacctgtcccttcgactaccacggacggtaccatttctacagaaacctcgaataactccagaacaacgccgtcgtcgacgaggaagcggaagaacccccctcctccggaccaggccaggagccagaccagcccaagttcacttcctgggccttcgggtcgacagtccaagagacagaagatcccaccgactggcacctcttctacaggtgcttctgtgtcaacgagagtccaaaggaaagcaaaggcgtctgacaccatggatctctcagagtaagtgaaacttccttcgtttgaggctgcacggaatcaatgtcatgaattcatacttacttacaaagtggcccgaaccggcctcctccgagaaacaacagcagtacgacaactcagccagcatcttcgagcaggaaatcgagtcgaagcaagaagccggcaagtggtgctcaaggtttgtgtggacacatggctagccttgccctttattctgtacatacttacattggctcctcataggttcaaaccccgctgctacttcctcgtcaacacgcagatcaaaaagacacagcaacacctcagaccgcgacaccgcaatgactgggacagatgatcctcaggataacagtcctcccccaccaaccgagaacccttcccgcgaggacgacagtgaagatgacgatggcgaagatcgacgatatgatgacgaggacgatgaggacgatgatgatgacaacgacgaggacgatgaagacgatgatgaagatgacccgttcggtgcattcggcggtccgggcggagccgggctttcaggaactctacgagcactgagcggcatcatgtctggcttcacctctcgacttcgtgacctgttgaacagcctccgccaagacgatctatcagtccagctgatagcactgcaggagctctccgaaatactgcttgtgtcaaatgaggacaacttatctggccatttttcacccgacgctttcgtaaaggagcttgtggcattgatgaacaaagaggaaagcccggagattatgctcgtgtcatgtcgttgcctagctaatcttatggaagctctgccgtccagcgtggcaaatgttgtatatggcaatgcagtacctgtgctttgccaaaagctcctggagatttcattcatcgacctggccgagcaagctctaagcactctggagaagatctctgttgagtatcctgccagcattgttcgcgagggcggcttgacagcttgcctctcctttctagacttctttcccacaagcacgcagagaactgcggtaaccactgctgccaactgctgccgcaatattccggacgactcctttcccgttgttcgggatgttatgccaactctcctaaatgtcctggatagcaatgaccaacgagttgtggaacaagcagccctttgcgtttccggcattgttgagagcttcaaagaccatgcagacaaactcgaggagcttgtcagcgtcccactgctccgtgtcgtgttacgactccttcaccctggcagtacgaacctgattggttctaacatccacactcaattcctgcgagtgttggcatttaccgcccgtgcaagccccaagctgtcggctgaactcttcaagctcaatgtggtcgagaccctctatcaaattctgactggtgtatcccccccaagtggaactgaggatgttgcctcgaaactcgacagcgtggttattatgcaggccctgatccatcgacctcgggagcaaatcgtcgaaacactcaatgtcatctgcgagctacttcccagccttccccggaacgcagatcccgtttgcggcgactttgtagagctcaatacttcccgggaagcaaacacctcttcatcagatcatagcagtggttctaacgataagcgggtcgccttactggaggagtgcaaggaagaggtcagacggtttgcacttatcctgttccctactttgacggatgcgttctctagtacagtgaatctgagtgtccgacaaaaagtcttgacggcacagctgaaaatgctttctaatttggacaaggatattcttgccgaggcactaacatctgttccatatgcgtcctttatggcatcaatcttgtctcagcaggatcacccgactttggtcatgcttgctcttcaagctactgagttgctactgagccgtcttgatgatgtgttccattaccaattctatcgcgagggagtcattgcagaaattactgccttagctaacgagcaagaccctccaatcgaaagtaacaatcggaatagcgagggagacacaactcttaccgaagcaaataatacaggaaataacgccgatcaggccaggcacgactccagcaatgatgaggatgatgacagggatggagagacctcggatgacgaagaggacgaagagaacggtgacggcgagggtgatgatgagggtgatgatgatgaggaggaagagaatgaccatgaagcaatccacagagatgatgcatcgccggttagctctcggggatccacgatgtccctcgatgcacctgtttaccgactgtcttccgatggccactcgatgaagtcgcggatccgtcatgtggcaaagaaattcttagaggctcgtgagagtgaccaacacgaccagactatgagggacagggcgaacgtcattctcaacgatctttcaaagcttgccactgacctcgaagatttcttcctcaagcgtaccgctaccgacctctctcctgggcggggtagagttctcttcgaaaaattagcttcttattttgactccaatgtcctggagagcgtcaccagttccgagcttttagcatccggccttgtccgggtgctggtcaatgtgtttggcaatcctgatgagcaacttacgcgctcggctcggaccaccttcctcgaggttttcatgggaaatgaagtcaagtcaaagccaaagagtgccgcaggagactcgcctgtgacgccctacagcgtgatgatacataagctacaagacttgctcagtaggtcagagcatttcgaagttctcacagtgcaccaaaattctttcgatggtaataggagcagtcctgcatcaatgctagggaagcaaatccgcctacgtttagtcgctgatgatgactctgacatccctcgaccttatcggagcatcatggtctcaatacacgcaatcgccactttcaaatcattggatgaatatctccggcctcgaattagtcttagcgagcgacctcgtggctcacgacgagatggcctgacgagggctctagccgccatggctggtggtgcattccccatgagcaccgctgcagcagctcgactcgctggaataggaagcatgcctccgccccctcctccgccagcggccccctccttctcccgatcatcccgtcgagtgaagactcgctctaccccttcaactgagtctccgactgtccctgatcccctctcggaatcttctcgtgagaagggagtcttgaggcgcagttcgaggcgtcaggccgcatcagaggagacaccaacgcctccacgtcctcccccagacgaggatgatgaaatccaagatacactcgagtgtgcagatgaaaagcaactcaccgacgacgaggatatgggcgataccagtgccctagacgccatcgttggggatctgcaagaagaattgggcgatgaacccccttcggacccctctgctgtcaacatggaagtagctaccgaagggagcgtcacggcacgcaaggaagatggcagtagggtttctacaccaggagcctcaactggaagtaagcgtccagggccgcctccgccccccagtggtgcaacaccttcatcctctcggtccgtttcgtatgcgtccgccctccaagcgacacctcaggactggcatatcgaattcagcttggatgggaaagttgtgcccaacgaaacgacaatctaccgcgctgtccatacctcaaatgccaactccggggaacctgtgactcgcagtatttggtccgcaacacatcccgtcaaatttagacgagtgcctggacctccctccaccgagtccttgacttcgacctctaatggagagaccgacggagaatctgaaaacggcatcccggcatctttggcaaagcacccctcaactgcttttattttaaggttgctcaatattctccatgagctcaatgccaatatcgaggacgttctaatggataagaagaatgggatcgtgggcctttaccgtgagcccctctctcagttcgtgaacaccaaactcactgccaagttaaaccgccaactcgaagaacctctcatcgttgcaagcaactgtcttcctggatggtctgaagatcttgcacgactctaccccttcctcttcccattcgaaacaagacatctcttccttcaatctacttctttcgggtatgcacggtcaatgacgaggtggcaaaacacgcaatcagcagaggaaagccgccgcgaccgtcataacgaacgcccattccttgggcgtcttcagcggcagaaagtacgtatttcacgtaccaaaatccttgagtctgccctaaaagtcatggatctatatggcgcatctcagagcatcttggaagttgaatactttgaggaggtcgggactggccttgggccaacccttgagttctactccactgtctctctcgagttctcaaagaagaaactcaagctgtggcgtgacatcgattccgatgtatcaagcgagtttgctacagttcaaaccggcttattcccccgtcccataagcgaccaagaggcgtctacacctaatggcgaacgtattctccacttattcaagatgctcggaaaattcgtggcgaggtcaatgattgattctcgtatcgtggatattcacttaaaccctatcttcttccgaatcggagaagctacatccgcaggagtcaagccatcactcggcgcggttaagatggtcgatcctggcctggctcagtctcttatgacaatcaaggatttcgccatagcgaagaaacaaatcgatgaggaccccaataagaccccagcacagaaagtggatgaattagcagatatctcaatcgacaacgtgcgtttggaagatctgtgcctagatttcactcttcctggctatccagaaattgagctcgaagatggtggggctcatacaagggtgacgattgacaatgtcgaatcttaccttgcaaaggtgatcgatgtgacactaggctcgggagtacgtcgtcaagtagatgccttccgctctggattttcttcagtattcccttactctgcactgagtgcgttcacaccagacgagcttgtgaatctattcggaagaaccgatgaggattggtcccttgagagtgagttgacaaatggaccctatgttaagttttctgctgctaacctctactagctctcctcgactccatcaaggcggaccatggctataacatggagagtcccagcgttcgaaacctgctccaactgatgagtgggtttgacgccacagaaagacgagacttcctacagttcacaaccggaagtcccaagctaccaattggaggtaagtagaccgagcttgaatttacataaccccagaatctttgcatgctaacccagatataggcttcaagagcttgacgcccatgttcactgtagtgtgcaaaccaagcgaagagccatacacatccgatgactatcttcccagtgtcatgacatgtgtcaactatctcaagctaccaaattacagcggcgtcgaggtgatggacaggcaactctcaaaggcaatgaaggagggacaaggggcattccatctctcctagacatcgatgagagaacatgggacggaccagggagtatagatgtgtcttttggcaccagtgaagcgaaagatccaagtaccctctatgaattacgaaaagtacccttttaatcgtacgggaatcgaaaaggcgaggagcaggtggagcttaccggtacggttttgtatgcaattgtgtatggcgctgggggtcgggtcgtctattggtcaagaaccgacttgatgctcaaaataatgcttttcagcgtttatgaccgaactatagatatcttatgaggttttatttaagttggcttatcacttgacggtgcatgatgcgtgaaaactacatgatccagttcgccgtgcagctcaatcttgtttattcatttgtcttcaattgatttctcccatcggctaatttttacaactattatatcagcatgtgcccatgagctgttgacagtaagacggtattcgtctcatccaggaacctagctaagtcatatctctaaggtttacagaggcaaataagtatttcataaatgttgcccatttgcaaacgcccaaagacatttatcatgatccaccaaaagaaaaagaaaaaaaaaagttcaatcatcttcttcaccagagctccagatctcggggggcatctgggattcgtcgcgcagcaggctgtcgggaagcatctggctcttggagaggagctgcgaggtgctgtggccgttgttggagttggggaggaccagcgggggcgaggaggagccgtagtcctggaaggtcaggtggctgctggatgagcggtggtggtgcgaggagcggagggacggggtttgctgctgctgctgctgctgctttggctgctggctttggtgatggcggtggtggtatttgtcgggcgtcgaggctacggaggctgttgttgcctgcgaggggcgcacgatgctctgtctgttgtgggcggttggggtcttccggttggacattggggtcgaggggacgaggatggtgtcctcggagcccgggttctcggtcagccggtccgactcgctgcgaagctgggcctcgacctgttgggagatgctgatgcccatggaactgctgggggcgagctggttcgtgtagtttggcaatgggatgggttgctcgtcggacggagggtcggaagggagttcgacagcctcgacgggggctgcctgcccaacgtcggtgctgaaaagcttgtgtctgaggttggagagaagctggctcacgatggctggcgggaggtatttgtacctgccgatggtgtcgtggtaccactcctcctcccgcatgtcttcctcatcgcgagggttatttaactcatatacttggtcaatctcatgtctccattcgcttggcccttgctgcactcccggccgggggcatgcaagatattgaagtagggatccgtcatagagccagaaccgagtgacttggggatatatcttgaaggggaggtcgatgtgaacgagatgcccgctagcaagtcgtgatacaactgtgggcgagacggggaggaggatatctgtggcgtaggctggctcgccgaggccctggataactgcgagaggaacacgctgcgactcaagcggttgtgtctgggtgtgtgtcggtgcgggataacggataggctcgcgaagaggctttgaagagagaggttcctggggtgtaggtataggttgtgttgttctaggtgttgaacttggctcgtgcctttggctttgcgtcagcgcttcatcggctgtgctgcggtacgatgtgccaagttcatccaagacgaagagcgtatcgggtccggcagcaaactggtcgtcatcatcactatcctcgtcttctgtcgaatcttcaacgacctcaatgcctttgtctttgaaactgattctttctttctcttgtggaggtgcatttgacagcccaagtccttcaggactggtgcgttgagtttcagcgccagatccaccacgttgtgatttactggagcctggttctgtttctagctcattgataggagcctggttttcctgatcgatctcctcctcgccccagaattcagactcttcatccgaatcagggatttcccggagacccattgtagacttcatgggcgagaccctctttctctttgatggagacggtgtgctaagtcttgacctggcttgtgatgaccggagcctgcctcctgactctaaaccagcctctctgcgtggccttgctcttgtcggtgtgttcatcaattcttcatctgaagaactggtagtttctcggctcggagccaggcttggtgcgccaccagtatcacgggtgacgtctttcaagggcgaacgtttcgattgggtttggttctccgagccccagcttcccgttgcgtaagagtcttcaataattaatttccttctagtcggtgttggtgaggtcaccgtcccaggcagttcatcgagttgatgaggtctcgtgtctgcctgcgttccccgaacggacggtgactcgtggatgcccgagagcggaccataccgagagagaagatggctgctgagcggcgtggagagctggctggatgatggtatcacagcgcgtctgttgcgcttcgcaggggtctggggaatgattgaaccctcttgtgaagcaatgcgctgtgaggcagtttcgaatatgtcatccagtccaggtaagctttcagccggggcttgtcttggctgagggcttgggctgttgggctcacggagccaatcatcgaagccgtcgctgtcgacattttccttgccgtcgtcgtccatgtctcccccatcctcgtcctctgaatcctttatcagttgaccctttgcataacactgggtcagggtctgggtgtgatagcttgaacttggaggatcgccgacggtcttacgcctcgagtttttactctgcttcattcccacgttgccgccgaaagtccgccgtctcttggtcgtctgattatcgttgctcttctctttcaaagcaccccggcgctttctccctgagcgaactggttcctcctcctgctcttctccttcctcgccagattcggtttcatcaccatcgctctccttctctttgagaatgggcagctccgacggcacgtcattctccttgtcctcgactgcatttccttcagcgttcccttcctcagtcgcatcactcaatagatcgtcttcagcatcctcctcaaagctggacacaaaatctatctgtgttaacgtctgctgtctcaaccccttggttctctgattttgcctgccatatgtgcgaacagtcttcttgcgcggggggaactgggcctgctggagggatggggttgaattgtagattcggcttggcgcgggggcgcctcgggagcgtgttgacggcgccatcaagtcagcttctggccagcagtctgagggagtagtacagccagcatccggttaaggcagattagatcaccaagtcttcacctttacaaagctgtatagatgcgctgctgtgtgatgggacgggcatgtgctgggctgatgggtatggatccatctggtctatggtggggcgacttccctggccagtcgcgtaatcgcgtgtctttaatgggttttcgtcgcgtctttcctgatgacgtaagatgcaccacgcgattgtttctgtcatctcaaattgatttataaattgaaaattgatttatgagacacgcctttaagtggaaataatcagaaagtattgccaagagccaatgttcacccaatgtagattgatagcctcaaggcgcaactctcaacgcatcgtctgcgtccaaatagccagagtttacaaacacttccagcatgaccaaggaatgtaaacaaaaggaaatgtggccgaagaccgatatagatctttgctttccgggatttcgtgcatttgcggatgtgaaggactgagctgctggagctccgtaagggtattaataattatataaactcttcaagccaatctgccagccgctcctccccggcttcacccagggaaagcccttcgtgttccaccccaacatctgtcacctgtatcctacgaagagcctttgcctcccaggtctggaaatcatcatcccaattactgcgttccttgagctcgagtttctccatgctccgccgcatgagctccgcgagttcctctgcctgagccatgaatgtgttcccccgaggttttcgctttgagatccggccacccggcgtccgcgcgataaatttatcatgcatgagaagcgtcgaggggatcttcaatgtagatgtgcggggagggaagaggaggtgtgacttcctgggcaccttgatcggaagtatgctatccgcatccgcgtcttccccagctaccagacgcgccaccatgtccgatatgggcgacgatgctggcgagccgtcaaaatctcctggaattaggagaccgggattgtggaagaggaggcttgggctgatgaatggatcaaagaggttggctggtgttctgaacaggcttggcagctgctccggcacgtctgcaagatgcagtccgtctgcaagaggtctgtctgtcaagtacgagagccccttccttttatacttatgaacagggtggtcggggagaaacatggtccagttgtagatcccattgtatgcggcgactcccctcacaccaaacctggcgtggccatggcactcggtcaaggcaagcgacagggctaggctggcgccgaagaacgacccgtaaacgtacatgtcgcgtcgagcagtgctcgaaggcgcgagattctcaacgagccactcataggcaaaggccgtgtcgtggatgggtgttggccatcccgagtacggcagctgttcatcagcttgctctgcccaccggtaattgatccttgcgataggccactcctggaacgaagccgggagatctctcggcgtggtagcgtctcccgaagcgaatggagggagatggatcaacactggtgcgtcaggggaagaagctgccacattgaagaggctgtccaaggctcagtgttaggcagttcatatcatagtgagatccggattggcttactcgatgtttacatggccggaggaaccgcattggacctggactcgctcatgcgttctggtggtgaacgagcgcgaaggaaacactgggagagcaacaagccgggggcgcaacagccgacgccatgctcgcatactcttattttggcgattcaatcaaggaccttgggcagtcattacctcgtcggcattgattacgtacgagtgaagcgactggtgctaagcataaatctgcgatgatggtgcgcgacggatctggtagtttactgaaattattttgggaacctcagatcttaggccttccgcatctcgagcatcttcaaggatgtgccttgctgtaaaattacacccaaatgactaggcaaaatatgagaaatatcgtagagagattaaaatcatagattctgttttacatatttattactgagcaggcgcggcttgttatttttcatactgcatgcattatcagcgttacaaagcactaacaaacagcaccctggtagagggtgacataaaaaaggtgacataaaaacctggagaagccggatttaggtcgtttggtaactcagcattttttctatggatagtaagtaacaagtataacaatgagcaatcaataactattgggtggcgttttgcctatttgcgtggcttattgttaggcatacagactatctgatctcgtgttggaatgcagcttcagacgccgttgatttaccacgtttttgtcacccgccagggaactaattcgactaggcaactaacggcactagcgagtggccaaatccatcgccttggtaaatcgctccatgacctgcttcatgtgccgtgttccgacgtcattccctgtgcccgccatgtgcaaatcgttcctttcagggtcatgggactaactaagttcacctgtccttggacagacctcagagggaggtgttatcatggactttcgtcgctggtgttgcccctctcgtgcgatctgccactggcactccacgatgcagttttacacccaattctgcctatggtgtaactacagctggtgctatcctatcacatcgaaatgaatccttgttccgccgggtctctattcagtcaacaatgcaagccgagagtccgccactagatttgggtgaccatggtcgcttgccaagagagtatcgtatccagaatgatgaggcacatcttatgccaaggtaggtggccaagcggattgaggtctgatagccctaaataaccaaccttctctcctagccgctggtggtttgcgtcgtcggcatttcccatgatcgcaggcacccttggaccagtagcctctgcattcagtatctgcgctctggtcgtcccttggaggcaacacttggctcccggacaagatatcagcaaagctacatatattaatgatcccccatggtacgtaccgtgcacatcgcccaacccttctctccgtgggacgggatattgactcattgccctcaaggcttctcgcaatcaatgctatccagttggctcttgctctggtggccaatgtcttcctcttattgaatatggccagacgcgtccggttcgggatagcacagcctattacaatgcttggatggtaagacctcgccctaaggagatgccgaaacggactgaagtttgttaggggtattctaaacgtcttttactaggtacatatcggccatccttctcattgccctgcttgccgctgggcctgggcctcttcatcagggcctggacttccccaccgacgaaatgatctggtctcaagccctttggtacggcacttgggcagccatcctctatttcctgaacgcctcgttcatggtggtgactttcttgggcgcacgggctggttactaccccaaggacttcaatttgaccaagagccagcgcacgctgatgctgcagaccattatgttcctgctctaccttctcctaggtgctctcatattctctaaaatcgagggatggggctatcttgatgctctgtactgggctgatgtgacactattcactgtcggcttcggcgatctttctccgtcgacgaacctcggacgggcgcttgtcataccttattccctcgtcggcatcatcagtctcggtcttgtcattgcctctatccgcagcatgatactggaaagaggcagacgccgagtagaggcgcgtatggaggaaaagaagcgctgccggactgtccgacgcatgactctgaaaggggacgatatcatcctcaaccccatcagcgagagctccccgacttctccgtctgtcccgccttcgtctacagagagtactcaactggaaaatattcccagctccgagtatgagaggcgcaaggccgagttccaactcatgcgcaagatccaggaccaggcccatttacgaagacgatggatagccatgggaatatccactggctcctggcttgttttgtggctcgttggagccctaatttttcacaagtgtgaggagagatatcagggttggagctattttgatggcttctacttttgctatgtttccttcaccacagtagggtatggagactacactccaatttccaacgcaggcaagtccttttttgtcttctggtcccttctgaccctgcccaccatgaccgttctcatctcaaacgccggtgacactgtcgtcaaattcgtccgcgacgctacgctccgcttgggcaacatcaccattctccccggagatgatcgtttctccggcgaattgaagtacgctgcgaatagactgactctcggacgatgcttcccggactatatccaaccagtcttggaccctcgtaatgacctctctggcaacttcgacggtcatagcgacctagaatcagccggtgaaatatctcctgaccagcaagtcgaggcgatgaagcgaggccgaatgcatccttcttcgcttgagaaagacactgaaggatgcggcgaggccgagggccaaccagatggcccagcctatgctggctccacgtttacctccaaagtcaggcgctcactctcccgcctccgcgaccctctccaggatctgcctgccggcaccgatttccatttcctgctcatatccgaaatccaggtagtcagtcgccatcttcgaaggaaagagcctcgcaggtacacgttcgaggagtgggcctggtacctccgcctcataggcgaggacgagagagacccctcgagccacggcaaaccccgggccaaccctctgaacccttctccggacggcacagtacggcaccacgtagctcacctgcgcaagggccgccggcgccacagaagggagaaggttcgggatgtgggcgctgagggagtcgccgtccctaccttggatcagtctgaccaactgaagtggtcctgggtcgggcatcggagccctcttatgggcagccaggaagagagtgagtggatcctggaccgcctaacttgtaggctcagggaggccctttccgctgagaggaggcggcagctgaataggaggccggtaggccccaatcagcttgcgaggaggtatgggaggggtgtaccggcgccgaggcaatgacaggcctttggtgtgtatattttgacaataatgcggatacaattcgatgttagaaacaataccacaaacagtatcatgaacaatatcaaaaacactattagatgggataacttgagactattgtggcatgaccaaataacaacaacaataacaacaataagcagcattaagtagcattaatgatattctttaaaccttatggacaaaatattaatgatacagtagtcgttaccatgtttataagtaatatcaagtcaagtcaaaaaggttaggcggtgctatgacagcctgatcgtcaagacatggacggcgcatccattcgagcttttggatttggaaggctgcattgcgagcctcgacatccggccagcagccagccaaagtaggaggaaggaataaaccttgaagatcagatcttttaccaactgaaattctatgatcgaatcgttggtctaattaaaacgacggggaggcgtcaacggtgttttcaaggtgcacaaaaacagcaaaggcttaagcgtcgtttcacccctcgtgtactttgtctgtacaggaatggacaaggaaggcaaccagctccacaatctgatgcatgtcggctgcaccagggagaggttctttatgtagcaatcactccagaagcatcacgtcgctgggtacttgaaaagttggctctttcccaccaagagccatatgtcaatatggcaagtaccaacggcagataatgggcgaggttcaaggtataaattcccaagtgggaggctaccaagtaggtacctagtcatcagctatctgtttgttccctttgacagtatatatacaccagcagactgatcctgctatgactcctcgatcctgtggctggatttagccacttctttcgattgggagtcccaagtgatcacgaacagcttgcgagtaatggcagtttctccttcttcctctgtgaggttatgtttcgacaaagctctgagtttgtgtaagagcactgcaggtaggtctgcctctttgacgtaagaactttttccgaataagaatgcctgtgggcttgctgtgtggtatggcgcatagcaatcgagaccattgtggtcgtggtactcgtcggaaatgaagtgatcactgtggatccgtttgaacatattaatgcctcggtcgccaggatcattcaaagtcggggcaaccgagtgaactttgttaagatctgacgatccggatttgatcccatcgcggcattcgcggaaatcaatgtaggaaatacctaattcggtaatcggagcatagcgaactccctcagcaccgagcttttagaaataaagcatctctaaatcccagcttactaggataccatcaccatgagatgatggtgtcccgtaagttttcgggcggaggttgtgaatatggtctgtgcggaggtttccaagagtctggaaactcatctttgagtatgtaggtaataaagtgtcagaaatggctcagtagtttacgttcgggcatgtttttgcttaggtactttccacaaagaagatcttcggccggatactaacggctcttaccttctgtgggatcactcagctttttgtatcacgaagtctggaagaatgattgggtggttgaagactcgaggagaggagaaaggtggcttggtacagaagtaagtgggtgatattgcaattgagatactcagacattaagctgcttattatcgagtctgcggccattattatctaattattgaataccaatagtacatatttgagagataacatagtaatattgtcattttattttattttatactactggatttcttgattcatcttaggaagtagtctattcataaccactcctccgacaagtgtctcgtttctcgtatcacccacttgagtaggctagtaggttcataaggcctatcgtgttcgtttgttcagcgacgtaggagtctgtctacggtgtgtattggcgacctccttgataacaatgtccattgccttgtcaggtgtaagcgcatcatgttacgatacttgtttccggattccttgctactaccagtgatattgtttactggtctgtgcgatctcctccagtagccgatgatagcatccgatgtgagggtagatacgtcgggagcgatgttttctaggtacttcacgcgagccttcttttcacccgaggcatcatatgattggaagtcgtcggtgctgataggtctgcaccaagtgcccgtgtcctcttgctgatcatgaggttctgcgatatcgtcatactggtgatatcacgttagatccctggctcgctagctgtgtcactatcatcgtctgcatttacagttagttctcggcgcccgagccagcttcattttaactgtaccccccttcggcttagagtgtgggaagaagttgcccctctcatcgaagcaattatcgcaaaggataaggaggctcagagccctatgcatatcatcttgtgcgcacacgccgcccagaaggtcctcctgcttaacctcaggctcattaggtgcaggaaatgatctcctatatgtgaggccccggtcctagtatggtagttcctcaaatacaggatctcctagcgcgaagagtattatcattgcagcgttcaagagtgccatcggcggctggtttatgacgttagccttggagtcctcaacgtctccaacattttgcccaagtaaagagccataacgagataggaaagagaccgagatcgcttaagttttggtgcaagcttggcgctgtttgtcgtcaaggaatgcaatgataagaaacatctggatatagaagccagcatcattggcagtgccgcgatgtgtttatcttaggtacctaggcaagaaggcattaaagaagaggatacattgcatacggatagctcgagaatcctgcagaaaccagacaataacaataattccaactcgtgccctcaataatttgacaatatcagtcgagattttacaataaacactgtaatatttgagtgtctttgtcaatgtctctggatttgatgatcacactcttcgaagtgtagatacccctgtttagtctgccccctgttgtcatccgtgcaatcaatttttcaattcctcaatccagaaatggttggactctatcccaggtcagaataatctatacgatcacttgccacggataataaaagtcaatgtaggcgccatgcgttgaggggaaccttgtgaaatatgcatgtcttagagatctactttgcctacctgggttaataattaagtcatgagtgccagatagctctaccgaattccaacagataatcagagattgagagagattgagagcgagaagggacttaacgatttcctctcttcgtcgaaataccatgcccagaaaagagggtgcacctcaatgttgaagaacttgaatttttcacgagcgacttaatttctgccatcgtccaatgtatgtacctccaacttggcgtttccttagatctttgctaatcttccagattttgcatcaatcggtatctcatgcattgctatggattaccggaaggaatgtcgccgcaaaggcggccgatgcgcaccctttactgacgatgaggttcttgtccatggcctagcaacagttgccgaaattactattgcacagagattgtacggcatcaagatcgcatctgcaatcgccatatcacacagcactgttcatgcgctctcaaagctacatacgtcctctcatctatcaggatctatacaataggctgacatctaactgtgttgtgagtcaccgcaagatagatatggcgccggttttctttgatcccccccctcctccggaacctatcccatgggaagatttactcaactgtgaaactcttgatgagtttgaaaaggctttacagcggcgcgaagagcagatcaatgatgatggtgctgaatctattggacactaagctgaccaacgagggatcgaggcaatgcgtgatcttaagttgtgatttgtagcattctttagtcggagttgggtatcatcccatctttaactagcgtgtgaacctgtttttgtggttggttggttgcgctgatgctcaattaatcagagaatatgggaacatcaaggcttatcgggtgcgaagcatgttaaaattttgtgcgagtggacgatcacttcattagaagaacaacgggctttttgtctaagttaggtagtaataaacccataccttccgtcgccttccaattttgtccatcctgcaaattccctttccattggtttttgtgtaggttccgagatgatgctttccttgatgctctcgaaatgcctctcaaataagcccgaccttcggctatcttcttgtaccctgtcgctttgcccgcaggtaatgaatcgattgcgaaacaaggttgagtacggtgggcgtataataggaagaaaggcccatcgcgttccgccgagtaagatcttttcaggtttacacaccttagccgtggtccacagacgagcaaaatgtgacaggatatgccttcaacgttggcattaggaagcaagtcttccaggaaacatgagtcacacatgacgtgaacactatcacgatttcttcaataacgaatttgaaagtcacatgtggcattaaagctaaagcaatgcaaaaagaggtctgcattgaccccagttggtatctaaggcacacactatgaatatctttgaatacccgcttcgtctaaatactttggatcgaaggcattgagcttttcgcgagtccgcatagaaagcttcactacgcgttaaagtactgttaaaggcctggtgcgctcgacgggacttcattactcttttcctttatttatttctaaatcacttacgagaaggacaacgtgaacaccgtaatgaaagcggggatagcccaacctcaatacacagctcaaaaaggtagtaacggaacaggtgtttactgactgcatccaacagataatatcaaactcgacagaagcccagaaactactgctgattttgttaaacagagatagttggccaatccctagtcccgacagcagatagttgggccggctttttacagaatgactcttactatggacggcaactaggccggctaccccttaatcgctcatcttaacagcccacagagaggtcaggctcgtagcaatcgctcgttgcagagcaacacagcgaccactcctcttgacggcagacacactggtcggcaacacagctatcattcgtctcgatgagagacagctagatcatgcctgcagcaatcgcttgtcgcggaagcagacagccaagtcagcttcacagcggtttctcgggcgatacgctggtcggcttcgcagctgttgaaagggcatttatactatccttgtgaatgcatttgaatgaagagacataatgtaggtagaggctcttaggcttgaaaaagatttcctaacgaggtcttgttactgctctattatctttcctaatatatatgctccagcctgtgggttcctgcccagctctgggcgactctgcaaaaccgcaagccacctctgcctctgctatataactgactattatgaagcctcagacagaaacaagtctggccacttggtctagtggtatgattctcgctttgggttttaatcttgtttgcgagaggtcctgggttcaattcccagagtggcccggttcttttattattttttctaactgcttttaccaattggcagtaatcctccacattctcctgggcggagcttcgatgatttgatttttggtctcggaatgtctatctctaggtgagtgcaatgatgaggaatatatcaacaccgaacgaggtcgtattgcgattccgcccgcaaacgcctcagacaattgttcgagaaaagttggaaagacgggaggacgaagaggcacacttcaccattcttcgcaagacaagacagtgggaggcggaagcacccactgacttcgcggcagccagatacaagagattgttcgatgttagacattgacagatcgaattcgaggaggatcaatgggtgcaccttcgactgcatcgcggtgaagcggtgccggcacaaacacgcgagttcggggaggaatgcagcctgactggcaatctttcgagttggaggcgaaagtaccataaccggattgatccaactagctgtgtactatgtattgttcaggttgtttgcttactaaaaatactaaaaaagtgagttttcgtgcaaaaagtgtgaacacacaactgtgtgtcgtatcaaccgggccactctgggaattgaacccaggacctctcgcaagcaagattaaaacccaaagcgagaatcataccactagaccaagtggccagacttgtttctgtctgaggatctgtaatagtcacttatacagcagaggcagaagtggcttgcagttttgtgataatgagacctacgtctttcgctgtgccgcactacgctgactgaagacaggaattgctgtgcgccatcgtcgcagcttcattaaacaatctccgaaattagtcctgcctgaattggcgttgccaagtgtcgtcggagctagagatcggaatgtggcggtacgggcttccaacgcaagtcagtcatccaccgtcgtcatcgcgccaccggctcctcctaagcagaccctgaaaaagtagttggaaccttcaagactcgcatgattgcatacctaggtacctagcgacattcaggtgagagggtcctggattcctacggcgagtagctccaccgcctgcatggctggctttccttccttcaacgatatccgcatttgcaagtccctaataaaggttatctacgagccactggatctgacgcaccgcccctgctctcattaaagcgcggggctcttggtgggagggagccaacatactagcgatgcgcccacccactgtgaaatcacggggttacattagctccagtggcccctaaatttccaagcgaggccctggaaattacatagacctcattgcgccttgtgctcttttagccgcggatggcctgcagcttaacctagtcggacggttatcttgcgtcttgtccctgagttaatactacgctggacacccaaccctctattcctatcccctccaccatctctgttcacccctatcgtatcatcgttccacgaagacgagccaaacaagtacgtgctactaccctctgtcctgtatctcacaacctacacttgacatctgtggagcacctgattcactcctaccaattgttatcaatcgatctccagcgctagctcaagactaaccaccatctccagatagctctcctgccaacctcgaagcttctcacatcctaccgccaagatgcctggtgttcgtaagtcaatatatctgccgacgcaatagcatgttccacgagctaaccgtcccgatccagctctcgacgctcttcacaacctgaaggccaagctcaaggccgccttcaccaagaagtttgaaaagcctgccgagtccaagcccgccgagtccaagcctgaggactccaagcccgcggaagccaaacctgccgagaccaagcctgaagaaaccaagactgaggagaccaagcccgcagactccaaggtcgaagaaaccaagcccgaggccaagcccaccgagactgcccccgcccctgaacctgcggctgctcctgatgctgccgctgctgtagctgctgcagcttcgcctgctgctccagagacagccaagaaggaagaggccccagcaccggctacagctcctgctagtacgttcaacccgaaatgctgtagaatccggcttgtataagtgcggagtgaacggcgttacccctcgccccctctcctaggaggtggtcattgatctaactcgaaagaagccaccgcccctgagcccaccctagctgctgctcccgtcaccaccgaggctcccgctgccacccccgaggtcaaggctgaggccgctcccactgctgctcctaccgttaccgagaccccagctcctggtaagaacaaaccgtagcctagtcttttataagcaggcggaccgaaagaaacctcagcctggctaacaatacgacagctgctgctgtgacacccgctgccgccccggctccggaaaccgctgagaagaaggaggagactccagccactcccgccgccgcccctgctgctgctgctgccacccctgctgctcccgccgccacctcctaatgcgctgaccacgattgattgatgcttgtttttgtttggtttttcttcttctcttctttttgctgtttcgatgttgagaacaacgataatgtaccgttgttagttctgtaccatcgtttgttggattcgaaagtctaaaggtttggctttggctacttatcctacatcttacgactacggatggttggataccccctgagaaaacaggatgttgcgagcgataccatatacctaaatatatacccttgatagtcttcattgaagttgattgctcctcatatcacctcgctgtgctccttaattgtcttattttgcgaaaacttaatggagaaaagtgattccaaattgatcaaccgagctttcattctttccggcgctgaatatggatattatggatttgatatcgccaacaccttagtctttggcccacggcgctttcgtaacactaatctgcgcatttgtggtctcaccgccaaatgacctcccagtgggcctagcacccaaagatccggagcttggtcctgggggtgctctggtgtaaggaatcccaggtcccgacgacgcaggtggcatccttgtcgcctgggcccacggtgctcccgtgccacttcctggcggcgggggcgctgaggagcccgcgacggcggcagagactatgggctggttcgccatgtggacgctctgcgcaggctcagcagcctcggggtccaggtcccacgagaagagctcgccaaaggtgaagtgctggacgacggggaactttgacagaacctcggcgttgaacatcttgatcatgcccttgttgatcttgccccagccgtccttgatgcccgatatgtcgaacaggatgggggagtgttcccagaaggggcccttcttcacgtcgttgatgaacccgatggccgaaaagtacatgttcaccttgcggtagtcctcgacggcggtgggcttggtcacgtcggcgggacgaggggcaccacggacggagccttccaggggagttgcctcgttcgagttgatcgggcgggttagttgtgctgagccgaagatgtacggcatgaaggcgtggtcgtcgaggccccaaacgccgtgcgagccagccggctcgagggtgtaagtgaggatgagctttctcacaactctcaggtatctgcggtaggttagctcaggcgcgtataagtggaagtgacatgcagatactcacggctcgatcactaagaggacaatctctcgttcgatttcaccatcctgctgctgcccatcttggaagaaacccagcttccatagcccccccaggaaggcgaggaaactaagttcatgcccggtgccatagtcgaggcgctgggagctcccaaaggacccaaggagatagctggaaacctcctcctttgcctggccgttgccaaccttcagcgtctcgcccagccttccctcgtctagaaggccgccgatgcgctcttccaggagtccgttccattttcggaagctcacgttgccgaagcgtcttgggccagggtctggtggtgcctcgtcgagatatgactccactacctcgagcagtttctgcagagctcggatggactctgtatttgaaactgtgttggcggacggtagagggaagacgcggggtagtggggtgctgggctggtgacgaggaacgagggcatggttgagctggagtatgaagatccctatgtccctgtatgccaagcttttgaggaagcgagaaacgtctgggccatcattgattcgcttgatcggctttgaaaaaggcggcaggctagacaggtcaagtagcttgagcgtgggtaaggctggcaaggctggcaaggctggtggagccacgggcttttgaggaggctccatggcttgtgcttgtagtttgagcgaatgattaacccaggggggtgtaggtactccgtgatgcttttatatggtgctactattttaagtcaagggaagtttgtacaaaagagctgaatgtggatagcttggctgttacatctaggtacctagctagctatttggccaagctcctctgtgtgatgacatgaagttagtcagcacaagaatgaaatagaataaagtcaggtatttacatctgggtagtgtgagacggcgccaaaatatcaaagaggcaataaattatccacacggatacatttactttcgcatcgttatcccgtgtgaactaataggggctgttttaacggtgcgtgatttggttttggaagccatgctctagggtaggtaagtcaagggccaagcttgcacacgggcaggcgcgaaactacgcgacctcgtaccacaatctcaccttgcgatgcgcataataatccctggactggcagcatgaagagtcgagctagaccttgctcgcataccgattatgagtgatccttattctgaagaccgggttgtaagatttatcgaatctttacccgatgaaaccttgtgccctccatgggctgatcaacaggtggacccaaatcgcgtccaaccggaagagcaaagcgaacacacatcgggagcgcaattaccagagaagcagcgcaatgaaaccgagacatactttgatcaagcggttgagggacgagaaactataaccacaacggttagttcacagagcctttgtttactgttgaaggccatgggaaggcatgaatggacagcccaaggcataaaatgggaagaaaggttcattggtggagagaacgaggatcaagccatatggttgcgcgtacactctaacaagataagaagtgagcgatgtcggaggctcctaatgttcctacacaagctatggtttctctaccaagaggctccttcgggccatggtatgtacgaacagacgtctacagttcataaggccgagcaggcaaagaagtttagacagctgatccacgccattcactctacggttggtaaaatatgcgccaaggcacacgctgctctgtcgaagatgccagaggagaggggtcatgctgccaatactgcaaggagcttgcggtgtcaaatcattcctctgctcctgttggtcataaaggcagtctttatgacggggagccaagaggaaacgagtgatagctctcaggccttgccttcagagggcatctttgctgtttttgcaatccagatgatgcgccagattatggattgggtaaaaagactgcaccttgcgatggttaatgagctggaggtcaacccacccatttccgagaacgtggatattgaaacgaggcgtagagagtctcataaaatatccaaagtactccgccagctcaaattaccaaaccggcacatcatggactttacagccagactcacaaaagcatacgaggagttggaagaaaaggccaataggccaaagagaaagcgagaggctatggaagaagataaacgcatacggcaaaaacgagaggacacaaagagaatggaggaggaggcggtcgatcggcgcatggcactatttcgatcatctggtcaagcatcccatgcgcgaacttcgacacagaattccaacagccaggaagcagaaggtcacggaccgagacacagggatgcggacgaagaccactatactcagatgtcaacttcacagggactggctaaagttgatccagcccctattgcccacagagatcgaagacgcagccagaaacagaaccgttgggcgaaggaggagcggttggccggtagtcaaccaagccagagtctaccgcagggcgaagctagccaaaaagtctcttggtcctatgaagagagcaatattctccttacattgattcgcacgacgtcacaaccaagcctggcggatttaacagaaaaactaccgggacgaaacgagaaagagataagacagaagatatgcgagctcaaggaaacgtcgcgcaaattctacgaggagcgtgggttgatacccccaaagtggtgttgagagtggatgatttgcgttagcttaccgcggttttcgcttttggagttaaaatgatacccttgatttacaaaccaaccacctgctttagctatggggtagctgttgagccggctttcccgatctggggactatctgaccggcatcgggagtgaaagcatgtcgtgcctaaacatatgataactcgtagtcgagaagcaccaggagccactctttacccacctcgaagctcctcgttattagtttggttaccaacacgccaccgtgatttccataggacccctaaggtacccccctggaggcgctcaaactcacagataccccggctttccattgatgtgctggcgctgcaagcttgacatacatgtcccaatacatttcgtgaagctaacccgcaaattaggtcgtgccacagcttgcttgggcggctgatgtggcaccacttcgttggcggatagacccgcctgattgatgatagggtacgtacaggtacttctataggatacctccctcaggatacgcgtctgtcaagccggaacctgagctggtgtgcgcgtggggttgtatttctgacggaccgacttattctacctctgacaataagaatgctataatgaatggtgtttggatagatgggaaaggttactaagtaggtcagcacctgcatcctcagcaagcagggagctgataggcgagctttcggctgaaccagggcgtcaatacccgacatgttgctttcaaggtagatactggatcgtgcgaatctgaatggctcgccttcaaagttcctgcccctccagcttgggcaaggataaacccgaagctaggaataaccgtacgggggctgggggttaagttcgatattacgtacccctgaaggatcagtgatgtatgctagccggctttggatggtggtgaaacggcgagggcaaccggtagagggatgggcagatggctggatggaccggtatgagctgtcgtctgcttgggatgcgaggtggtgatgcccagcccgtgctcgaccaaccgcccggccgccttggacaatggatgggatggctggatgtgaggcgaacctgccgggtggtaattagctgtgcatcctcgtgcatgatgggtgcatcggtgctacaagacagcgggagtgagctacttttagtgccactcgacccctgtggcacagtggggcagcgctcgacgaacaccctgcgctgacttttccaacgggcgtgcagcgcgttgagatgggcgacttcccctttgctcgcctcgcgcgcgaaatcacaccttggcctcttctccaagttcccctgacctcaagaacattcgttttcttgcttcgttccctggttcttctgcgcgtggggcttcgacttagcaggtatctgatattaggtacctttttccgtgtcttcatcaaggactggctctcttatctttcaggagaggcgagctacgatcgacacaataggaggcatctgaggtgaaattagtgtgtgagtcgctaccccgtgcttatcgcgagaccccttcccctctggttcatgctgtggctcatttccaattgcgctctgcctttgaattcgagttggctcatgcttcaattttagttgcaactgcattccgctgtctgattcaacatgtctgagaccgagggattcgaagtcgtccaacgcgatgaagtcccccaggaagcttcgccggtgtctccagctaccaccaaacctcaatcggcttctccagccaccaaagccagcccggcggctaagacagcaaccacgggagcgtcgaagcgcctgagcacgagctcaaccacagcgactcgccgtcctggcacaactactacaaccacgggagcgagaacgaccggtaccgccactacgcgtacagcaactgctggagccaccaagcctctcacgcgcccggcggctagcagcacgctgaaccgcccaacgacgagctcgagcgcgaccagccaccgtagccgacccagcgtcagtgcgagcgaggatgagaagaagtctacgacctcgacttcgtctcgacggacaagcaccttgttgtctagcccatcaaagaccaagacaactcctacgagtaccaccgctgctgctcgcaagcctgcaaccgcaactagtactagcagccctcgcacaactacggcagctagatcctctacgaccacgggcactaccgcaacaagaactgccacctcccgccttggaacggccccatctacaactgatgcaaggaagcgattatccactgctggaactcccacacctacgtctcgaactaccgctactgcccgaaccgtcgctaagcccgacgcctcggcggcatctgccaaggaaatcgaggagctgaagaccaaggttgctgagggtgaggctgagatcgaggccctcaagacccaggttaaggagtcggaggagaaagttgctgctctcaccgagcagcatagccacagcgaacccaatggggacgatgcgaaggttgagcagcaatccgccatctcaacacttgagagccagctctcagagaccacggcaaagctcgaggccgcgcaagcagagctcgagcagcacaagaccgatttgtcggaggcagttggccagaaggaagccctccagtccgaaatcgaggctctgaaggcatctctcgagactgttcagacagagagcgccgagaaggttcaagccagcgacgctgcgttgcagaaggctgctgatgaacataccgcaaatattcaagagcttaaggattccctcgctgaacagcaaaaggccgccttagaggggcttgagactaagcacaaggaggagcttggtcgaggccaggcatctagtgaatcgcatgaggccgatatcatagcactcaagtcagagcacgatgcagctcttgccgagctccaaaagaagattgacgacttgtctgcttcacaggctgctttggagtctgccagtggtgacaaggccaagtctgagcaagacgctcacctcgcccaggttgctgcacttgaaggggaaatcgcagagttgaaggccaagctcgatgctgccgataccgcggctgagaaggcccaggctgacatcaagtccatcggcactgaaatcgagaaccttcaaggatctcttgctgagaaggagaaggaactggccgctgctcaggatgacttgaagaaggcccaggatgaccttgcagctgtccaggccaaggcagccgaggctgaaaccactcttgctgccaaagacgaagaaattactaagctcaagggtattcacgatgagcgcatgaggtcaattactcaggactacgagaccgagattgagagcctccgaggtgacgcgttctttaagcgcaaatttgaggacctggaacgtcagcacactgagctgcaaacctcctcgactgaagctgaggagagccacgccaaggcagttgaagctgccaaggccgagcatgccagcgctgtggctgcactggaggctaaggaggctgagcatcagaaggacctggaagctcttcgagccagccacgcagagcagctcgaatccgccaagaatagtgcctcggccgacaaggatgctgtattgagcgaactcgattctctcaaggctagccacgctgagcagcttgaggttttgaggagcgagggcgagtctggattggcaaaggagcttgaagccctcaaggcatcccacgctgaaatcatcgaaggcctcacgaagagcagcgtcgaagagaaggagaaattgctggctgatcacgcagcagaattgtcgtcgatcaaggagaccggagacagtgctcatgcgaaggagttggctgacatcaaggcagagttggcctcggccaagacagctggagacgaggcgcacattgctgagctggaaaagattaagtctgagctttctgctgctcaggaggagaaggagtcagcacatgctgccgctattgctgcccttcaagccgagcttacagcagccaaggaggctggaaatgaagctcatgccgctgaacttgccagcatcaaggccgaactctcggaagcaaaggaggccagcgacaaggcgcatgctgctgaactaagtgcactcaaggaggagctcgctgctctcaagaaggaacttgcagccgccaaggatgaaaaggagacccagattgccgagacaaacgcagccaagtctcaactcgaggctcttcgacttgagcagactaatgcgaacaaagcaagtggcgaagctcatgctgccgagatcgctgccctcaaggacaagctcgccgtggcggacgaacagaaggagctgcgtgctgctgagctcgtcactcttcaggctcagctggcttcccttgcgtctgagcacgctgattccaagaaggcaaccagcgaatctcatgcttccgaattagcaaagcttcaagcggagcttgtgtctgcccgggaagcaggaagcgaggcgcacttcgctgagcttgctggtctcaaggcttcatatgctgcggctgaggagggcaacaagaagacacatgatgacgctctcgctgccctcagatctgagttgacagcagcaaatgaaaagagcaagactgagcacgcagctgaattggcaaaactacaggctcagcttcaagaagcccaagccgaggttgagaagattgagaggaacgctgaaattgctctggacagtgctaagttggagctggaggaacagcaccacaaggagattgaaaagctgattgatatcaatgctgaatcaatccaagccttgaaggcggagggagtcaacaccaagaaggaactcgaggagctcgtggcatctcacacgaagtctcttgacgatgtcatgactgagtacagatccaaggatgcatcctttgaagagaagctttccgctgtcacggatgctcgggataagcttggtgagcagctgaagactgtccaatcgactctggacagcgcacaagctgaggttgatgagctcagccatcagcttgcgcaggagaagttcgaaaggatgacagcgcttgccgagcttgacgcagcgaagagtgccaagcctgacacgtccgctctggatgcattgaagaaggaatacgccacactcaaggaagcccatgagagcacgctggctgaaaaggagacccagctgaaggatgctcaggatgcccttgcggcggccaagactgagcttggcgctgtccatgctaacctctctgacgtccgtgaggacctcgagctgtcacagaaggatctggaagctttcaaggccgaagctgatgccaagaacaagatggccaaggccgactacgaagacctcaacgacagtatgactaccatggttgaggacgctaggaaggaggcggatgaggccaagggcaagctgaaggagcttgagacccaggttcaagacaagacggcatcgatccaaggactggagaagaagctcgaggagcttcaagcagtattgaaggtcaaggaagccgaagttgttgaggctaaggtatgaaagcgcaagcctcccctcccccggcgcgcatgttactagtgggtgactaacggattatgtgatctaggctctcgccgcccctgctaaggccaagggtcttgcagacagcagatatgcaaactccaacgacgacgacgacgcggtatcagcggaaggtgaggaagacgaaaaagatcacagttccgccggattggccttggtgcgaacgccccttgcatgatgccagccgtccttcgggtggtttccttcacatagatgtttatgaacacaagctaactcgtgcttttttccttgatttagctaagtagtgcaaggctgacggccaagcaagtcctcactctcgaccgcgagatgcgagatcggaatctggccatgctgaacacaatcactgataccaagtcgtctgtatgagcagcaatctggcccagtgcacaaatatgtggcatgggaggttcacagttggtatttcggagcattatatattaaaacttgtgcattaattctcgtactatttcgttgctgtttggtttgaagctggctatcatgggaggatgagtggatataggtgatgtgcctagaaagtgaggatgggtgctttgcgtgtgggcgaatctttagttcttgttgaggaaagatgacacgataccctttagtgcagtcgttgcctctaatgcattttatcagcgtacgtacttagccaaatcgttgaatatgggccgccaagtgatatctccaacaagtgcgtggtgtggaacacaaggctgccatcgccgtccaacgtgacaaactatcaacacaataaggagttgaatatcatgacagtatgtgatatgatcggtttatttccgtttattatcaaagttattcatttcactagccatattatccgtctgtaacccaccgtccaagtgctcactgcgctgttttatgctacgtactcggtgatgcgttcacatcgcctttcccttgggatattatcttggccaggcgggctagatgtaacatgatgttaccactactcatggatttgctccttgactagtttttaggatgccaactcgtgtcgatctttgacgttgaaagcttggaggaggaggggatcatgtcctactttggcttggcaatacgtcaaagatgttacaaaattaagcttatcccaagaagcaagtcgacggataggcacgagttgttgatcccctggagagaaccaacaatgggaccaagagggctaacttgacctgatatcttggtgcggagtgtacggatcaggatgcatgaaggcgcgtgattaagcttgaatcaggggagcgtatttgatttaggttgcgctcaagtgggccaagttgttcaaaccgcggatgaaggatggagcaatgatctgactcggaatgtcctgactgtggcatggtcaagccatcgtcgatctgacctaggagtgacgttgtgcgagggaagggtccagcaggtacctcgcgatgtatctagaacccaccacggcattggaccctcgctgcaaccgaccggcaggcagctcaagcccgaccccgatgaccacatgctggggaccgccactggcgggcgcatggtctaggcggcccaggggaccctgtctgcccgccagcgccctacaagcaccctgcatgggcgctgggccctcactggccacgggctcgattagtcaccattaccacagcgcatgctatccctgattggcccgacccagatgcgcgaacaggccacctcagacagggtgcagaagctgccgcattttcaatgacgtcttgcccgacacgaggacaatgtgattgtcgttgcagcgcgatgtcatccatgacatcgagccgtagcctccgagcgaagagggtccggcccagcaaccccgtcctcttccaaacaaacgtgtcggcactagctgtatttcagtagatgcgaatcccgagcgtcgtctcctgcccaggtacctatgtatccgtgcaaatcaagtttgctcgcccgtgacgaatcaatcgcccattctagactccatctcatcttttcagcccggcgttttcctccaacccgctatgttcctagctcgcggcccctagagtctccaatgaccgccagctccagaacatttttgtctcatctcccctttttaagcttttcccttctctcctcctcctcttgctctgttcccccatcatcgtcctcatcgcagcacaaacccgacgacggccttgcgcatgtcatccgcattgaccgataatgcctgaagttctacatggcagcatcaagaggtcgaattccgaccctggcctccaccagagcgatgcctccgacaataccgctgccaacacgacaccgttgcagaaagccttaaccttatcagataaccatgttgccgaagcgccacctcgccgcctaagcttcgccctcgggagacggggcagtagtaacaatccctcgttctccggcaacgcggcaccgacgagccccggcacggcgaagcgaaagggcagcattcaggtcgacgaggcgcccccgaggaagagcctgtcgtacgcgctgaggccccaggcggaggcatactacgattcgagggcggccacgcgcaaggagttcaagaggcgggggaagacgctcgaggaatactacgacgacaatcccgagctgctgccgcagctgcccttcacgtggcaccacgggaaccggcggtggcggctgtggttctttgccttcatcgtgttcgtcgacgcatccgccgtgccgattgcgctgtactatggcatgaagtacgcgggggacgtccaggagtacatcattttcatcattgtcacgacgatatggggcgggccgacgtatctcgaattcgggatccggacactgcgcctgatgaagaaggagaggttctaccgtcccctgggcacgacgaaccgctggtgtgccgacatgttgacgtgggcttctgcattgacaattaccgtcgtcacggcgctgttcattgtaggtagcgccccgcatgatacctggttgcgtgtggtgtcgatggctgctccgtctattctctggtgctatggtggcgtcctactggccatcactctgctgtatcggttcaacattcccgcccctttccgcattagttccaccgcaaagggcggaaaggtatgtttacaatgcgagaagacaataggccaagaagatttgatgctaacctcgtgcttgtataggttcttccaggggtgtattactttatcgaggacacacttgcggtcaatggaggctgcggcgcgccatatcgtgaggctctcgcagcaagatatcgggccagccctcgatttcgcgagatgctttatgagcaatccctgttctggtcgatacccacgttgatcttcgctgccatcttgacggtcattgccgtcatcccccaagttcctgagaattggtcttacggagtctgttgggttgccccgtttgggttcaccttcgtctggggccttattactatcagatggtgcaaagcacgtatggtcagggagagattggaatgggaggcaggagagttcccccgaaagatcccatcacccagtgagaagtcggtccccgtacaaaattctgatcctgttgcatgatcgctacatttaatgaagatatgaagaagacgaaagcaaaaattccattttagcgttggggtagagactgagctagacaaatatacgtaacatttcttttcatgggacgaaatgatcctatgcactttaaagatgtgaccattcttgtttttcgaagcataatctcaaacacatgagttctatttatccggtgcaacccgctaacgtgcgatgtaaaactttctacaatttgcctaccggccgcagcatcaaaggggaagtaacatcggctgggccgccccagggtgacaggtccacgacgagagtatcgacgacctcgaagccgcacttggcgtagaggctctgcccagccttggaagactcaagataggaatcgattccgaggcgactggactcttccaaaccccaattgatcagcatggagccggcaccccggcgctggtggttcgggtctgtgtgcagcagcttcaggtctttacaagcgatgttagccagcccaagcaagcctcatttattaagatgacaggaccctcctgagacatacaagaatagggctttccagcaaacctctcgttccgcttcgcgatcatcccaccgaagaaccgctcgcaagcctcgggattggtgccgggcggccaggtctcaggctcgtggacgtggggttccgtccagaagaaccagctcgcgaaggcgatcatgtcccggccctcgggcaggtcggtgtccacgaccttgacccagcggttcgccgggtccgcgcggaggatgtcgacgagcttggacgcgcgcgggtggctgccatcggtggacggggggaagggtcccgggaagagggcgcggctcatgggggatgtcccataggcgacgtcctcgatctcgacggcgcgcttggcgtcggcctcggtggatgggactactttgaggcccatcttgtgtagtgcctgggacaaagttgatgagtgttgggagggnnnnnctgggctggtgggtgaaagttcacggggaagagggaacgtgggatggatttaaaccattgagcccatactaatatgtctgagcataggcgagggaaccatgctcatcatactcgctaattgatggctgagctgtaaatcttcacctggtgatgccaagggtttgtcggcgagccggtttgggtaggcgggggattacaccgtccttccccacatgagctcgccgataccaagattggaaagtgacgacgtgggatttttcgaagcaaggatgaaggtgagttagtcttatacaacgggctccgctgtgaagtttgaagatcggtagtcaggcaattgtgagggaatgacaacgactttcgagtatttccaaaagaagagctagacgactagccctgtgatggtcgctcagaataaaatcattccgccgagaacggtggaatggaaaaatgtcttacaagcccatcgtcgaggtcgatgaacatttcgctatgcggatatatcattttgtgtccagtgatgggatggtgagagatcatgttatataagtgtataaacttacatggacttgattattgattcctcgtttcccggggcagcgatactcaaagtatggcggattcgatactcaaagtatggcggattcaaggcgctatttggctgtagctgccgacaaaatagaggcaggttaaattattgtctctgcttctgatgttctggttgatcgcgttgttaactttgctgctgatgttcttgttggtcctgttgctgacttggctgctgataaaataatggcagctcaagttgctgactttgctgctgatactgttactgatttcgtcgctgacccctttggcgtttgagagcttgttgggtcggggtaggcgagggtctatgttgcgtacttagattatagtgtgttcgatcttggtctttgagtgaaattccgtggtgtttccaccagtagtcttcctccttacgctcttgtgcctcaagagctcgttggtcccgaatatcctgaggcgttcgtatgtcgctggaaaatgacggattcaacctacagtatgagacagtatttagacggtatcctgttatctgctaagttattgttattaacaatgtttctaatatcgaattgtatccatgttattgtcaaactatacaggctgtgcgtgtcggtacgcttctaatctatccgacatggattacggtagacagaagtctttttgctggtatttattcatgaggcgatacagtatcccatgaggatctactgtgtgtattcctggccttctgatatcaacaaccttcacgctctcgcgtgacgcatacacccagtttaaagatgttgattccatgaaggcgtttgtggattcaacctgtaagtgcccccttgtcttcagacggatccgatttaaatgctactatcactaggtgctgatatctgcggcctaacctcccaagacagcgaagcagttgaaagatacctgctctgggtgggctgccatctatcatgtattctccatcgagtcttcagagaacatcatgaccatgccctttgaactccacctgtctaggttggatgtggagttatggctccggcatggcgggtttggactgcgccttttattttccttctgcttccttcttttgtttcgacttgatctcatagaagccagcagctttctgcttactcttttgcttctgagtctccatcgaagcactcatcatccttctaacatccgtcacatccatcttcaccggtccaggatcctcattcccacatcctttccttcatctccctgttcaaccgactccataggaggtggagaatccagcacggcatcagcaaccatccgtccgacgcgagtcttcctagaccccaaaattctcgaaagaagtaacctcaaaccattccatctcatgaatctagataaaaaaaagtgacaaagtgacaattaagatcttactaggagagattcaagcaacttggtatcagtgtcgaagtgtattgagaaatcaaaatggaagtactgccctctcttgaaggccctgtctcgtacgacctctcatcactggtcccaaacatatctctccgcgagtgccatctttggccgatgctgaaaaccaaaagagttccacccgaagctggtctccagtgcgatcaaacctgatgtctgtcatatcattcctttgagtttgaacagcaaccgcgcgacggaacccggttccctattgatcttcgtgctacggtatattctacctctgcaagacgctgaggacctctttgagctacttttgctaccgacgaccaggacgagcctgttctcgcgttattggacaaaccatggaacatgttgactctgtctccccaagttcatcgctctagggaccattgttacttcgcttttaagtaggtggaggtcttgaatcccgatatcaatgaggagacacgaaccgtccgcgaaggcaaagcggcagcaaggttaaaattactccggtcaacaatccattggtaatacccaccaagaatagtactctcgaaccgactgagacggggacatccaatgacgacttggatatattggcagcgggtttcagcgactgcctgtagtttgagacctgtcgtaaaaccagcctctgttgtccgaacgtaatctaggatgattgcgtctgcctctgaactgggtgcggtgaccgaaggacctcccgtggtgggatttaccgcatgagagcgttgtacaacggcaactgtcttttgtagtatgctataatcataatcgagcgcatctttgcctctctcctacctttgtaaagagcgatggtatttcctctgctccggtaatggatgataacaaacatactgggataccaaaatacgaatcaatactggtttccatcctaacaataaagtcattataaaacattttccatgcttgtcaaaccgtacataatgaatttggacactgtaataggaaaaccgccccgtctttctttgtgtcactctcgaattaagagagcagtgccggttgtgcgcccgtcgcaccttcctcatttttaggtgaccaagaggcctccgtggcctcaggccacacaagattcatcttggcatcttcaccatccctctcaatcaattgtttgaccacaatccatccgtttcatcattcctgtgtgcgtaattatttgtggccatcgagagagaaagtttcctcccccgctccaacctcacgggcatctacgaaccagacactgtgctcaacatcaccccattggatttacagctccatggcttcttcacctatcactttaaagccggaggaaggacgcgtagggatgctagagacgcaagttctagatgctgctttccagtgtcagatgttcctggccgttgcattcctcaacaccgaacagtaccaggcttatactgatggcgaggagatttcggattttctcctactatacttctcaggatatataccttatcgagctaataagctccttctgttcatcttagtactaaaatgattgcacctagctggctctatagatagtaaaattaaacctaaagccaagtcttattatattccttaataagatatagtactaagcctatactaatagtaaggagatttcagattttctcctactatacttaataggatatataccttatcaggttaataatttatatctatttatcttagtactaaagcgatcgtgcccagccgactctgtggataataaaatcgaacctaaagctaagtctcgttgtattccttaatgatatacagtaccaagcttataccgatggcaaagagatttcgaatactctcccaccctgttctgctggatccacagcttatcaggcgaataagctacttccacacgtatcagcaccaaagcggtcgcgtccagacagctttgtggatgacgaaaccgaacctaaagctaagtctcgtcgcatggatgcgcctggtcctggacctgcagagccccatctccatgtcttgatgaacgcatcggacatcaaatggatcccatcaacaactcatcgggcttgatgaattcgttgtactcgtgatcgaacactttccaatgtaccagatatttcttctttccctttggatccagctccgccttgacgatgggatcgattcaagtgcttccccatccagtcgaaagactggtgaacctttttcctcttcgagaaagccagtggcttcgtctgccgcccgggattttcttctcttaccttagtcaaaagacggggccaccgagttcactatcggactgagttaatcccctcaagtctgtgctgtgcaaaagaaacggcaacttaacttttcactccgaggaatggcctattgtgggggcgcagaagtcttcttcgtccatcccgaggacgcctttctcaagggcgggcgattccggctcttgcatttgggatatggcaggtcgtgtggcgggaatactcacaagcggaactggagctgaggacgaggagatcaacgatacaacatatactgcgccaatcgagtggcttttgaaggatatcactctcaaacttggagaggagtcttcctccagtaagaagcctacccaaccctcacagaatgcgcacacgtttcaattgccacatcgaaacgatggcatctacgaaatttttgataagcacaaagttcaaaaaccagatcagaaatgggaagatcaccgaaatgttcttatctcagaagaagaaatgaccagttatctgaaaaaatgttgagacagattggctaagaaaagaatggaaagaagaatgttacttacctagccaatacacctgcagcatcggggttttataatatagaggaccaagtggaccatgatagtgactgatattgtaactacctaattatggttacttgaaagtatcatgggaagagaagatttcaacgataataatgtgaaagattcttttgtagcctacgacttgagataatagcctgtgattttaccgacgcgtttggagtttattcccaatatggtcggatcatccatctgacaatctacaggacactgctaccgcaatagactcaaggatcgaactattcccgagctagaatgaaagacaatattatcatctgaggaacatcgagacaacgtggcaaaataagtaatatagattggaaagttttgggtggtaggataacctcaggcatcaggggctttataataatagtttgggattatggcggtctagactatggctactgttctttgatgccttcggctgtaccgaattcgttaccaaggagagtcggatcaaaccagttgcttccaccgaactcggtgatattattacagtgggatagaaccgaacgaaggagccatcagcattggaacgattcaattgagatggaattttagtgtgattggtccattgggatagcagacgacgttcctgtcgctgatctaagtctgtgggataggtgctggaagtgtgcaaaattcattaacgcagcaatagggagaaaaggaagagccacacggtagaaggaacagtctcctgatgcatacatactctgggagggaacgaaaagatatactttaattatcctcccctttgagattttcagagtagacagattgaagtgagtgtttcagaaacgcgcttgtagctcttccatcgttgccgatattagaacatgttctagtgagatagccatgacacgatagaacgtcgtgggtaaattcagtttctcttcatcgtctactcattccttcccagctccactctgcaggaagatctccagaatggcctttggtccaccaggatgtgacagcagctcccacaacttccaactctcctcgatcgtcgccttggcgcgcaagaacatgtcctcctcgtattcacggactgcctgatcccggccttgcgctgtgccatgctgctctagcttgttcgccaagaccaacgcatcgttcatggccacgttgacaccctcgcctgaaggaatcgtgacgtgcgcagcgtctccaaccaaagtcacgccaggcacagacttccaacccatggtctcagctggtaggccatagagcggccacccccggaaattgtccgagtgtcgaatcaagtctttgaactcctccgcatatccgccgaagaattcctccgatagaagtagagctcgcgtcgactctgtgttggacaaatcggctgtggtctgagtgaagtcttctggaacagcgatgccatagtaaatcctgtaggcatggtcgccttgtcgttggatgacgatggatttgggcccattaaacacggagctagacccagggccaaacttggtggccatgtaatcgtggattggatttccctgacgtattctcgtctcgatatagagcttccctgaatacttgggcttggccttggtgatctgggggaaaagcaacgaaataagtacacactcgattaaattaaagcagctggagagtgttcaatctatacataccaagggccgtactttgctccaggctccgtcagcaccaaccacgaggtcgaatccagattccgtggagccattggcaaactcaaggacaggcctgccatcggcatcaaagtctgccctcttgagcccgtggccccattggatcttttcctttgggatggagtccagcaagatctgccgcagtgccagacggtcaatctctggccgttcttcctccgccgggatgacatcgccctcttccttctcgccaccaacctcaccccagcgtttgccctgaggatcgaagaggtcaaacttgtcgtcctcatatctggcatgcttcaagaatgcgccgtgcagttttgcttctcggagtgccagctgccccgtctttgggtggatatcaagcgagccgccgccccgatctgagatgctggacgattcgtcgcgctcatagacgacataatccacgcctttcacctccagcaatcgtgctagggtcaagccacagggaccgcctcccactatggcgacagacgggaccatgttgtttctctggagaatccgggctgagtggaactgggaactgatgatggggcgtgtgagctgggaagcagagcgttttgcaacaacgctgaatgctgatttgagcatcttggcgaatctgtcgagaagccacctgagcaggatttccttatcgtcttatatagtattgtttttcacgttggggaagagagctcaacgaaaatgagacggagcttcagtggactttctgggagtccgccgtccgatctcaccacatgatgaactcaatgcaagacagttccagtgctgactgccgtgcattcactagtgagcgcttgtgttatgactgatcttgatggctgagggttgtgtgttgattcgggtggatctaagttccgacgagatggaatggcaagcggctgagataaaacgtggcacgccagagctcttttcgtgcaagctagagaccttgttctcttattaataataaattattctatattatttagcttgatattgtattgatgactggattaattgttttgatattgtgtcgaaatctgaggctgtatggcctgactgggtattggcttagtctctcggaagttagaaccgcccgatataatgagctttggtcgtgtcggcacctggtcaaacccattgagattcctacatatagcaacagcgcagcaagaggttcggctcttgacgatgatccaacttggcgggtccagattgaaatttgaattggtctggccgtgactcatttcatctcgctaacccaactcacttttcttctctcgctttttaactgatactctctctccggcaactccccccgaactgtggagtcttccggcgccgtgcctgagacggagaagaggcaatgccaaggagcaagtcgggctccctttcggagagcaaacaccaagagcggagggttctcgcctgcgttctgtgccaaaaacgcaaggtcagatgcgaccgcaagtctccctgcacaaactgcattcgcctgagggccaactgcgtgcccggctcactcgggcctcgtcggcgtcgcttcccggagcgggagctgctgctgcgtctgcgaaagtacgagcatctcctccgcgagaaccagatcaaattcgagcctctgcacaaggaccatgccggctcggatcatgagcttgagcgtttggcggacaacgaggcgcaagcatcatccggtagttcatctccggcgacaactaccggcactcaacctaggtaagactggctgaactgaagtctcctccatccatacttaaactgtcttgtattcacatggcttctcaatcttcaggggcatgtggcaggcaatgagaaactgggtaagatcaccgatgctcttccgataggtgataggatagccatctgaaccaacgacgtattaattatctatcaccagtaccagtatttggaaaacgatgatggcccttcccagtcatgcataggagaagacactctacgtgaagctgtggaaaaaatggcctgggaggacttcacccgagctcactccaatattctctttggtccacgggaaaatgccaggctcgacttggctggcctccatccagacccaacgcacattttccacctctggcacatatatctcgaaaatgtgaatccgcttctcagagttacccatgctccaagcctccagggtgtgataatcgaggcagttagcaatctgtccaatatcaaaccggatctcgaggcgctcatgtttgggatctattgcatcgccgccacaagtctgtcagacgatgaatgcattagcaagttcagctcatcaaagagcgacctcctgacgagatgccagtttggctgtcagcaggctttgatgaactgtgagtttctgcgcactggcaaaaggacttgcttgacagctctgttcttctacgtggtatgtataacatgtccgccatttctaatacaaccatgcagagagctcattctactgtttccagtgctccatccggcctacgaccgatcctactactctctcgtcacttctcgccatcaccgtccgcatcgcccgccggataggcatccacaacgaatgggccaacgccaagtgcgacgtcctcgaggccgagctccggcgcaggctgtggtgggccatcgtgctcttcgacatgcgcatcggcgagatgtctcagttcgacgccggatcgctgtcccccatctgggactgcgagatccccctcaacctccacgactcggacctccacgccgagctcaagcagccgctcggctcccgggacatgcccactgagtccctcttcgtcgtcgtccgcagcgccatcgccgacttcatccgcaacgccggcttcttcctcgacttccacaaccctcgcctcaaggccatcgccgccgacatccacggcggccagcccccgcccgcgagcggcgaggtgacgacgctcgaggacctgatcgagaacaagtacctccgccactgcgatctcctgaaccccctgcacttcatgaccgcctgggtggcgcgcttcttcatcgccaagtaccgcatgctcgagcagtacggcgccctgatgggcagcgaccagccgccgaccgacgcccagcgcgacgccgccaacgtccacgccctgagcatgctccagtgcgacaccaacctcctcgtctcccccttggtgaggggtttcctctggctccaccagtactacttccccttcccggcgtacatccagctcttccaggacctcaggaggtggccttctagcaggcacgccgaggcggcgtgggccgccctcagcagcaactacgaggcgaggatgatccaccagggcgacgtcttcgggctcgaacgcagagacgcgacggcggcggcggcagacctccccgactccccgctgttccgtatccaggcccggctcgtcctccaggcgtgggaggcgcgggtcgcggacaagggggagccggaggaggcgctcgcgatgccccggatcgtcacgctggtcaaggacaggctggcgccgtcgtcgtcgtcgtcgtccgccgcgccggtgcccacgacattgcctgctgacccgactacgggcgagagtgtgctcagctctggagagtcgaatccgcttgatatggccgcgccgatgtcgctgccgtctgatcagctctccatggcgtcctggaacatgccggacgatctcacggggttgtggttaccgcctgggtttgccaggcctatgccccctaacatgggcggaggcggcctgtatccgtttggctgggcagccatgcactgggggatgggtaatcctggagggacgatgtgatgtgggttgaaacaagcaagggaactcgagggcaggagttggtagccaacacgccgttcttcatagtcacaagcaagcaagccgtagttccagatctttgatcggcgataataaaacagtgtcttcgttgcctccatccgtcctatgtatgctcgttttaatccattcaaaaacacgccactacttcgaacagagcatcattagactccataacaatacaaccatggtcgcgtgaatccaagaaaaagaaagacaaacgtcccacaacaccgttcctactccttcccaaccctcctggagatgttggtatagttttaacatcacttgaaagcagccttgacatccgccctgggccactcgaacagcacatcgccctcgtacacatcggtgataatccgtccgattctcgactcaacatccacgtagaacttttcgctctcgcgaatcacgttcgcgacaagatcgcggctcagcgccggatcgtctgcatcgccaaagtgcttctccactcgcttccgcagcgcttcgatgcccttgcgcacctccttggagtcgtagttgccgaggatcttgttaaaaatagttttggtgtttgacggctgggccgcgatcagggttggtgccttgccggattgcagctgggcctcaatgttctccaggtgatcaaggagcttgccgagcggcctgcgcatcactgcattgaggtacaggcccatatgttcgtggtattccctgcttgcattgtttttccagatttcgagaacatcgagtcctcgtgtgtccgtctcttcaacgaaatggttcatgttctcaatgagaagaatgtggaagttcagagcctccttgtcctcggggtctcctccaccactcgtgacgcccactgcagggttctcgcgagcaatgacgagaagggagtcaaacatggacttgagcatccggtcgtactcgcggtccactgtccgccggatagggagattggggtcaatcccaaccaacatgttctcaaccactgtagagaaagcagggaacacgcgaatgaaatgaataactcccttgcgcttgtggatcttgacctttgtctcttcaatggcccggatttggtcatccacaaatttcctgaaccgaccaccaagcagaccgtgctgtttttggaaaattgtgttgataaagtcttggttcgtttggctaatatctgccatcttcttctcaaccgccacaaacatgcccactccttgcctgtcaaaattgtcagtcgatgtgctccagaattgcggataaagaggaaagacttacaaaggatcctgcgatatgacccattccatcagcttttgcagatcatgatccaggaatgagaaaatggtctccatggaccgtgtgacacgtctagcgagatcacggtcaggctccatgatacgatgtttcttgagatcaccgccacgacgatcctggggcgtgctagaagcaaccgcgtctgggaagtctgtctgctcgagcgttgtagcatggaagaaatcgatgatgaagttttgttccatttcaaccagagggagcaactcgtccagaacagtactgaatacttcccatgggagggtcccggaccctgccttttggcgatcagccttaccctcggagaggggagatcgcagagcgcgggcgagcgtctgacttcgtttcaccgtcatctttctagccgctgtcgccacgttctcctgctgcttttctatttgagtggtgaagagccatacttgttcctcgctcgtcaccttgcgggcgttcttgcggcagctcatcatgatactctggaattcgttcttatacacaggatggctcttctcttgatagatgccaagcatgtggctccagcttttcaaatcgacgtctcgggcatagagcatcaaggggctgtacttccacaggacatctcgaccagtttcgtggtggctcgagtcacctctctttgctagagctccactgagagcacgtttcgtctctgcaagtgccagttcgaactgttgtggcatgaagccgatgaggtgctgcatgaactgcgagctctcttgcacgtacatttccttcttttcttgaacaatcctcatgttaccgtagtcactatcaagtcccaaggcttggtcatcaactgacgaatccccggcctttccgggatcgcgccctccgaggctaggatcaatcttgatcatagccttgaagaggacaactaaggaattttcaacttcagaaaggccttggatattgtctaggggtgccgtacgaagcacttgtagatcagtgctggtgattgcacaagtctcaagaagagactcgagttcctgtttcagcagcttttggtttgcggcttggacttgaagtccttgcccttgtgcttcaatataggcaatatcttcggacaatgtctgcgacgagttagaaaattctagtagagagaaaccatcgaatactcaccgaaagctcaacagaatacaacgttaggagattgtccaactcctcgcattccaagatggcgacatcgatacccagcttgatagcgtctaccttgtcatcttcctcttggaagcgcgctagccagccaccggcttgtgtcttattcaactctcgttcgaggtcggccctcatgtcatcgacattcccggactgcatttgctcaccagggatccagccaaaatggtcaagccatcggccaaatccttcgcttctattatcgagaatgcggtggtcaacaccgagactctgcaaatattctgtatccttccctacagctcggactggtctagccggttccttggggaaagactcgggagcttctttgataagagatgacacgccttggccacttaatgggcgatttatggtcggcaccgcaaccttgacgtcgggaatgttggagcgacgctgaggagcacgcgccggaacatctggagttggaggggcagagtcttctttgggtgtgtctggcttagggggtgctggaaccacgtccgtgatcccgtctgggccgtcggtaactttctgggcagccagtcgtagtcgctctccggcacctcctcgacgaggtttaaatgctgctgccgccgctgccgccttccagaatgctcccgcaacctgctccttcgtcttcggagacttgatcataggcccgagaccgggtctctcctcctcctctgccttgctttcatccttggcggtattttcatcatccttggccgatgttgcttcctgagttcccgacgttggtgctgccgctgatacgggtgacaccttggatggctgctcaaaatcagtttgcaaggatagtccgtctttgcccgttactggcaaggggatgctaacggcctgagaaggaatagggagactgttcagtccatccgcattagaatccgatttgggaacctctggactttgtataggtacgacgggagtaggatctgctcccagagaggggctaagggcgggaggatggttgggaccttggctggtagagtttttgcgtccggctcgctctgcacttcgtggtggcgggatgacggtatccttcttgccagggccaccggtaccaggaatgagaggtgccggcaccaagtctctatcttgtggccgtgttggatccatgggaggacgcttcctctcagggggtgtttgatcccccagtcctcgactcggcgggggaacgttctgcgcagcttgctcatctcgagcagctctgctcggtggtcgcatgagtggaagtggcatggggggtgtctggtcgtctctcgaacgactggctggtctaggcgaggtttgaccatccctcgctctactgggcggtcgcataagaggaggtgtcgagctttggtaagcctgatcctcccttggccgacttgacggccgacttggtgggcgaaattggtcatcaccgccgcgtcccactggtggtgtaaaggaagtaggagggtgcgacggttgcccatccctcggacgacttgaagatcgaaattggccttgctcctctcttgctcggctaggcggccggccatgttggttcggtatctgtggcagtggttgggtcggcggctcagcttgaggacccggtggaccatttcgaaccgccatcgacatggactcttgactcttgctattctggaccacttttcgcaggttggtcctatcccggtctctcgaggccgacgaatcgaagctgccagcaggggaattggtgccactgggcggtagctgtcggattggaggggttctagtcgttctaggcgggccatcgtgagcgccagggatatgcggtgggaagttggggtggccgggcattgatggcggagaagccatgcccggtggtggtggcatcgcagaccctggtggtggcctcattggtggtggtccgttgtgataatggccgccagtgttgggaggccgcttgcccgctcccatgacttgctccagctctcttggatcgaaacccaagagctcaggaaccaggccgcccgtatatttgccataaatcttgatcatactggcgatgaagaacttcttctctttatccgactgcgccatccaaaaataaggcttcaccaaggtgactatgaacccgttatcgccagcccattctcggtgctgagggttggcttgcgggctggtaaaggactcaatgtgcgtgaggtcgtccaagttccaggtcttgccaatggagaaggttccattcgggttctctttggacttgtgcatgcggacgcggcccgatttccggactgcgatgatgatggctcggggtttttgggattcgggagttcgagcttgcggaggcggcggcgtcgcaggatgcgtcgagaattcggtgatgcgaaggtgggtgatgtacgtctcctggactggcttagatgttagcttcatagacgagaaaaagagctggcacagagctcccggagctggccagccgaaatacgacggtcaagacgtacgcgtcccatccggctcccgcttgctaaagcaactctcgatgatgcgacgcttctcatcttcgaacttctccctggtgcctggggtggcaggaccaaagccgttcccgtttgtgcgctccatttgcgtggcgtgggccgttcattaaggagaggacgagtgggctatgaacggccttgggggcattgtgcgcaagcacagatgatctccgcgttgattcgtgccgttactacttggagatcgctcgggcgaggtggaaggaatcccacagcccgttcatagcttggggagacgtggagaggttggcaatctggccaagcctcctgtggcgtagcatcctcctaattagagcatcctgggcggtagccacagtgggactggcagctcccgtcaacgtcagcgcaagcacttggcttcaatgtggcgtcacggctgtctcagcggggtccaaccgttaatagttcaggcgattgcccctgtaaaatgagctaacagcaatgcgaagaaacccaacctagcactgacggaagaattggattggaaattatagaagtcgtttcactcatcgtctaacagaataccccggaggataggggttagcaaaggaaaaccaaccacgctattagacgcagaaaattagctgcgtgaatctaaaatagcagccaatcatccctccttcaaggttacacaagacgccctcgagcttccgccagattctcgaggattttttgtacacacgaagcgctcattagactcaaacacaaacggtgtgcagacagtacttgtgagtgcgagccaggtatgttttcaatatagaatagccttgctctcgaaataggcaaaatatatgttctttcatgctacaacataatgcaaaaactatatacccgggccatatttctctaatgcttcagcgcactctcaaataatttcctgagctggtccttctcggcctccaactccttagataatccaggtgccagcatcagaactctcgcctgagggatcgttccctctacgagagattcgatgtcgcccgatccaaaaccgagatctgacaggccactgggctggtcgccgagttcagcgaggaacttggtgatggcttctgccaagacctcgccggcactctcacgcttgacgtttgaaatatccactccaaaagcctcggcagcagccagatggcggtcagggttggaagcagccgtaaatcggaacacagccggggccgataccgcgacagagacaccatgggggatcagcgggctaggaacatcgtatcctgcatgcctgtatcccgggttctgtccagaaatgggataagacatgcctgcgtagtcagtcagtctcgttgcttgcttaaaaaaaaagattgttctatggaaattccttaccgtggcaaaggtgaactcccgcatttccaaagccaacaccggcgagagttgcggcaagaagcatctcgctctgggcttcgaaatcatcggggtcacggacagcgcgtgggagatatttgatagtagccttgagggcatgaaacgagaacacgtctgagatggggtttgcaccttggtaggcgggacggttaagagggtttgtcggcctgggtgtccgctcatagtaggggatcgccgtccatgattctaaagagtggcacaagacatcaaggccagaggctgccttgacagccgagggcatggttctggtattgagagggtcacaaataccaagagtcggtttcaaatttctatgcgcaacgccggtctttgctttcttcgatactaaatcgaagattgctgtgccggttgtctcactgcctgttcctgccgtggtcgggactgcaatgagcggcagtaatttcctgtcaatcgggcgcccctttcccaggggagcgttcacaaagtcgaggaaatctgcctccggatatgcgttgtaaagattcataagtttggctgtgtccatgacggaaccgccaccaactgccaaaaaggcatcaggttggtacggccgggtccatgcgatagcctccttgatgctatgtagcaagatctatcagcccgcatttcataatcgactgaactagaaagcatatacttacgagctatcctttggttcaattcggacgttcttgaacacctcgaattcgattccttctcttgtgagaccttctcggacctgcttcatggcgtctagcttatccacggtggggtctgtgaccacagcgaccttcttggcacccagattcttgaaatccatgcccacctccttggtgacgccggggccaaagcgaattgatgaagcagccatctcaaaggcatactccttttgctctgctgcggccggtgaggcgaagcgacgtccttgtgattgcacatgagaaaggaggtttgatgatgggttttgctgatgatatccggggtttgagtggcatgggcatgaaggagggtgtgtatattgaattgtacggaggaggctggttgcccgcttggcggcctgggagaaggtgagtttccattccctcaattgaggagctcagcggcacttacattaggcacagccctaattggtgataccattatgtagaattttggtgagatagatattcgagagattttttatatctggcctgagcaatggggtactagagcaggggaagaacgtgtggttctgtagccacatataaagaaagacaacggaatggatgatgtgatgagatccgacaacggattttggtggacctgacaacgacctcggataccaacctaaacatcgactagagaggaggagcccagttcttaaactacctagctcaattagcctgcggggaagggtggtatccatcccattctgccagatcggatccgacagtgtccaatccacatcgttgtgtggttgatggatctggcatcatgcagttacaggcgggagtggtcgtgtgatggctgtactagcgatctttagtcaacatgggagcccatgattcatagctggctactctccgcatcgacgtaacaggaagcaattgcctggggaacgctagacatggttaattagtccctagcatggattctcacaatgccagatagcactaacaccgggtttaccagcactacagccttcatccgctatacccgtattacccgatccaagcatctccagaagacaaatgatagaaactcgttcattttttcaagattcctcaagtcatgagtctatcggaaatccggaaagtcaatatcggatccgatactatctcaagggctccaaagtcgtgaaatgaacggatagcacccttacctacattctctgtaggtggcttacccgaacgggatatttggaaagatgaaggcgaatcagaacgcagcagtggtgcaactgtaaccaacgattgatcattaacatccggcattataggtcacttctagatctgcagcctggtcatgttttcagatatggattttattaattttgcaggaacaagaaaatccgggcatctccactcagtccatgtccagccgcttctggacaatttccttaacctgtgatatatccagagcttctacgcttctagatttttgacctatcatactctcagccataaacatcgagttgtaaatagcctcctccgttgcgtctgcgacagcttcgaatatgccggtaatggtatcgttatctgtcatttcgactgcctgtgcgcttggcgtatatggattgacggcttttggtgcggccggattcatgcttatctctgggaacgggatgtgtgccgccgttgagaaggcaagaaagatgtctccggatgtgttggctccgtacccgccaaccttccccaatcccaccgtggcacgctttgcaagacgctgaagctgaactggcaggagaggtgcatccgtagcaacaataataataatactaccatctttccgtggcccaccgtgcgtctcctcggtggtcttatctgacgctgcattttgagctttgataatctttccgaccgggatgccgccaatgtgcaggttttctgccgagccgtagttggcctggactaggacgccaactgtgtacgttgttgggtttccggagacatcgaaaccttcgactgaacgactgctggagcccgtgccacccttggatctgtgacaaatcattcctgtcccgccaccagtgtttccttcaggtacacggtctgcggatgccttctctataccgcgagtcacaagctgtggggtgacggcaaacctgcttgggtcgttcaaatatccatcatatgtctctgcgacggtagggaagaggaacaggcccatatctccatcttcattgcggtagtgttggtagcaatactcgagaatgccacgataggcatcacccactgatcctgttcccgttaagacaataggtgaagttaaaaggccagtctcattgatccagtgtgttcctgtcatttcaccgcagccattaaaactgaacacgccagcaaagcaggcatatttagcccagtctttccggaacaatatagtcgtcagcccagtattgacactttggtccgtctggacggattccgtgtgaacgagaacaccaggcacatcggtcaaggaattgagcttgccagttggccattttcccaggtcaaggccgggaaagacctcgcgaacacgagcccttggtgtttgaatggagtgagaggacatgatgtaattgtgaaatgtacaatatttgatagttatcttttatgatgcgatgcgcattctaatcgagttggcgtgtagcatatatactctctagggaatcgtacccagattcggatctcgggtttcgggtttgagtctcccggaacaccaggctcactccactctacgtggacgtgaacaattcctcaactgatcgctaatcggtccgtcgatagtatcatttggcttctgcctaggtattgtcgacacgatacatatagcaggggttggcaaaatatgacgtgggctttagacaaggttacgcaatcgctctcacactgccaactcaaggagtcttgttcaaacttgcaacaactagagtgtggatataattgagcagcccagagaatccaggaactacctaagagacggatcggcgtgttagttttctctttggaaaaccggtaggaagcctgctgctttgttgctaagcaacttttcacgtcacaagcctcgctatctgatggtatttttttgtgtgattcgagatcaactatattaccaccattctcgtccatactcagaatctctgggctttgtctgcactctggaagaaccagctcgtcaagagagcaaggtgcctgggaggagaatggccagcctgctgatcatcgctgaaatttgccatttgcattgagccattacgaattgagcacaactgcattgagaaggctttcgcttggtttgtatcatcctagccacgtatagcaggaggcctcgggggcctttaacgaaacctgcgaatgtgtcgcctggtgttgaggctgaagtgtgattgagaacatgccaagggccgatagacagctcaaactgtccatgaggctcccaaatatctcattcatcggaatctatccggttcgctccgtatcatcttcctcgtaacattgatttgcttgagtagggcgacttttctcacgtcgatgacgcgtcgtcggtcggtgcggcgttgtccattggaaaacacgacagtgttgtcaggcaaaacttccccggggcggactatagacttgggagaaatcgtgcagttctagattccagtcagatgtcgtgtcacacagaaggccgactctaatacgcaccttgccaactttagcaccacgtccaatcgtacttccgacttggataaacgtgccctcagatatctccgtgcctccaggttctacagttgcaccggcctccactataacataatcaccgagggtgattcctcctgttgacgagagagatgagcggtcgcccggttgtgcgccaagttgtgcacgctcctgaataacgcatcggcgcccaatcaagacgctaccttgtgttgagtcgatacgagcacgtggatggataacagtttcagcttggatcgtaatcgagtggtgaccagtgagcgatgcatccttgggaatcgtgagcgaagacgagaagttgactggaggcttgggaccgctagaaggggcaattgactgccgcttgcttgaggacgacatttaaaagaattgttcaagcttttacagtatggggaaaattaatgcgtcctataaagggccataaataagaatatcgaaccggtgttggtgtactgaacacctgatgcttgttatggagagcttcatctagctccagtgttagcgcccattggaatcttcccaatcagagtcgcagaagatcatgaggtcagggaatattgggagattcggctgccagattgtctgctaataaatacatccattcgctgctaaaactgtgtgggggcgaggtagcggctaactgagttgatgagtaatggaggcttggattggccaatcatgctttcgccatttctttgcatccaccaacttgtggtcaactcgaagtgccgcagcattatcacgacctctccgtgcctcccccattgtatcgccaccacaagacgacacgatgctttcgaagagagcgacgcctgcgagggccgctaacctctcacggactgctgtgaggggtctggccaccgtccaagatgccaatcctgttcggcactacggaggtctcaaggaccaagatcgcattttccagaacctctatggacgatttcccgccgaccttgcgagcgcgaagaagatgggagattggcacaagacgaaggagatcattctgaagggacacgactggatcatcaacgaggtcaagacttccggtctccgaggacgaggtggagctggtttcccttcaggtctgaaatgggtaggtatttggacgagtgcagctggccggcaagtacgcaattatactaattgtactcctcacagtctttcatgaacttcaaggactgggacaaggacaacaagccccgatatctcgtcgtcaatgctgatgagggtgagccgggaacatgcaaggaccgagagattatgcgaaaggacccccacaagcttgtcgagggctgccttgttgctggccgagccatgaacgccaccgccgcctacatctacatccgaggcgagttctaccatgaggctgccatcctccagaatgccatcaatgaggcctacaaggacggcctgattggcaagaacgcctgcgactccggttacgatttcgacgtctacatccaccgtggtgccggtgcctacgtgtgtggcgaggaaacctccctgatcgagtccatcgagggcaagcctggcaagccccgtctcaagccccccttccctgctgctgttggtgtcttcggatgcccctcaaccgtcgccaacgtcgagaccattgccgtggctcccaccatctgccgccgaggaggcagctggtttgccggcttcggacgtgagcgaaaccagggtaccaagctcttctgtatctctggccaggtcaacaaccccgtcactgtcgaggaggagatgtccatccctctccgtgagctgattgagaagcactgcggtggcgtccgtggcggttgggataacctccaggccatcattcccggtggctcgtcaacacccatccttcccaagcacgtgtgcgacgaccagctcatggatttcgacgccctcaaggacagccagtccggtcttggtaccgctgccgtcatcgtcatggacaagagtgctgatgtcgttcgtgccatcagccggctgagccacttctaccgccacgagagttgcggtcagtgcacaccttgccgtgagggcagcaagtggactgagcagatcatgcaacgattcgagaagggtgagggtcgtgagagggagatcgacatgctccaggagctgaccaagcaggttgagggacacaccatctgtggtacgtattctacccattatcatctgccgatcatctatatactgactttgatgttcctgcagctctgggagaggctttcgcttggcccatccagggtctcatccgtcacttccgacctgagctcgaggcaaggatgcagaagtacgcgctggagaatggtggtgctgcactggctggtggatggcacccctcgaccaggcagcagggcaagctggtcgcccctggtcagtaaaacatagtcgggagctgctcgtgagggtttcatttagtctagaggggacgcggcggccgtaatttcatgagcccgcgtctgtgtacctatgcatagtaaaccgtaaatgacggtggtgtattcgttttgttaaaatcagttttcagccatcctacatatcatcttcgtgaccgtgtgtggtaaagcggtgtctaagtgacgggagaaataccaggcaataactcccatccagtccagcctattattgtgtgattccactccgatctggtgaatccggaaggcaggtaactgcgagtgtgttggcggcctgctagtgatgggttttattaatcgggcccacaacccaacccgatggtcggatggaagaaatgcttcgtttcatcaagggctcgctccttacaaccccaaagcattgggcaagagtatttttctcttgcagatttggctcggtcttggtcaatatcgtcttttggaactgcgtcttggtttccgggttgatccatctatctgttcagaaggtgggcctcgctcatcctcaccgcatatcccatcaccatggttagcagctacgagcacttcgtcgccttcggcgttgataatggtacgttctggcatacactatattatggatttatggacgggcatggctctcgttcggcctggcttagacgccgggtgaatctgatccaatggaacaacaactgctccctatgtatcttctaagttaaggcctcaatgcactcgctcatatttcccaggcggccttgagaggcttctccgcctcttccagtcatttttcatgatcttgacgtcttaccccgtcctgatcgcccagctcatgcccacccaccctgtctcggtccacatggccaccgagacctgcctcaagcagctgcagggaaccctcaacgtcacccgccgcacgttccgcctatttcgcttcctcgagacgttcaatgcctcctacgccctctacctgtctgagaccaagaccattgagacgtggctcgacgtcgcgagcaagtcgtcgctggccaccttcggcatgctcgagtccgtcacgctgcccgatctgctcggcgtcgaccacctggagttcttcggtcccgcccagaccaccaagatcaacgtggacgcccagatcttctggttcatcggtctttacacctccgccgtcagcacggcgatcaagctcgtgcgtatcctggcatactctcccgtcccccagaccggcgagggcttcggcaccggcaaggacagcaaggagaagtccggtggctcggaaaaggaggagagcaaggaggagaagattgagagcgagaagaagctgctcaaggaggctgccgagaagcgcaaggaggagcgcaaggagtgggccaagaaggtcagcaaggagacgagcctcctggggcagaagctcctcgccgatgttctcgatcttattattcccgcttccgtcatgggatgggtccaagtcgagactggcgttattggtattgcaatgtttactacctccgtcctgaccggcttggatgcttggaggagagttggacgggacctggagaggcgccaggctgcttagtggtaagcaaggtgatgcctggagagcgttgaattctattgtttcaagcaagtaaattgtagaatatctagatagaagttacgtcgtgatatatccccggaggttgtatatccaactccatccgccttttcagatagtcgctatagatctttatcgaacctcatgtccgtcatatacaggcattgagcatcgagcaagaataagagaaagtcgcgtttttcctattttcaaatcatttcgttaccgtctaccggttatcacaaaccggccggtctcgatgcgcatcttccagccatcctggaaaagagcggcagctacaccttgtcggagccgcgatactccgccggcactatgacgtccgataccagtaacaactgtcaagctctgttccctagcttttctgactctggattctccgaggccgtcccaccaggactgcactctctggcgagcaatcctgataccgtccagcacactgacaccatgcaagtcgatggatgtcgatgtgctctgcttctggaccaggagctcagcggcagcagatgaaagcatgtgagaattctgggcctgttcatacgaacgctcccgatagacagcggcagcctgcttatacagagaattcgagccacctttacggaggagttgggaagtatatgcatcagtcgcccgcttggcgtcccaagaggcttgtgctttctggttcatctctgcaagattagcaccagtcgataatgaagatccgaccagtggttgcatgggtgtcttcagctctagcgttctggcattcccagccgccggtggcgcagcgccttcaatttcattgcttggcaagggtgtgaggcggtagtccaagtcgatgcgctggacccatggattcttcacaaagtatttgctcagcattccggcaatgtcgtcagagaattgtgaaatagagctggtcacctggaccagggcgaggaggtagtggtctggaatgttgcggtacttggcagccagcgactttgcttgggctttgccctcagcgtcgcgagcctggattccgtatgaaacgaactggtcaagaatatccattacggttgcgccactagagcatcgcttcctgtagaatatatcagagacttggtcatacgacatgtcgattctatcggcaatgaacgcaatctcttcctcatctagaatggtacgatgtcagtacgaagaatcaagaaaaattaactgcaaagggggaggtatgctaacgtttaatattcttagctctgacgggctgtccgcttgagggagaaaatgatgtatcaccctggatgctgttggcccgtttcttggcttttctctgttttttcttgctcttggtattggtagtggtatcaacatcgtcaggttgaaagaagccgtctatccccttttctcgttgacccgtcgcctcgagaaactgaatattgagcaagatatccagggcgacctggaggtcaccgttggccttcttcatagcactcttgatgtcgatctccttcaactccgtgaacatgccccgcaggttgctgaacttggtctcatcactatcattgctgaatttggtgagactaggcatagcggaggatggttctgctgaggaggaggatatttcagtgccttcagaggctgagcccagagacttggggacacggttgcttgtactcgtgacggtagcacttgtgctctcatcatcgtcagggtcgaaactggcgttctggggaatattagagacacctgtcgcgttgaagcctgtcgcttcttcaaagacagccgactgggagagcccgctaagaatctccttggctgtttggtagccttcgggggtagttaagtcatgatcagttgcaattgcgacaatcaagggttcatccaagagggatctgaatgagtcctgccggtgcaaatgaaatatcagcacatgaataattcgatgagtatttcccacgtcacatatcatctcgagctcctctcatccacttggatccccgtattttactaaggagggcttcaagcatcgctcgggcctctccctcgtttgagacaatatgccaagccggggaacgctttcttcactcaccactagactctgcataggatcttggtcatttccagacggcatggtgtgagccagtccgccagccggcaagagggcgcggggagtcagataaaagcgtggtgtaaggtcttgtgttggttgaagatctcttcaaatacagcatgatctaagatggggctgaagcgaattatttgtatggcaatcggaagagaaatgtgacagaaaacgctggcctttgtacggaaaaaaaaaaaacaaaaatttatccaacgcgtgaatgttgatggtctgttcagtcaatttctgaagccagtaaccaatgactctcacattgaatgacggcagcttaggccggttcaggctccgacatcaaactgcctggctccgcctgaatgtgaggtcacgtgtgtgtactcggtagacaacgatgaaataacaaatcccgtggtagtctctcatcaggcctcacacagtctgtacggttctgaaatacacaggaatagtaccttaattatttatcgagcatcttctcgaagggcggcaagggtgtcctaaactttactcgctcagtctgagctgcctgaactgtgtttgtctcacacgaggctctcacgcgtgaccaactcaagtgcgaccgggaccgcaggaacccggtatatttgccgggggggacggacttgcaactcagccccgttccacgaacatgaggacgagcggaaaggcaaacattaggcttcagtacagactctattgccaccatgccaccatgcagataggtactataagggtcatgcattcacccataagcgcaaagaaggttcagacaaggcagtacaggtacaggactaatgcagccccggaaatcaaggttggtgacgctgtgcagccaggcccaataaagcacaatgtttactctatatattccccaactacatatttattgtttatatatcagccaatagaaaatatgatgaatattagaatagtttatgcgtcgaataattcacagacacacatgtcgcatattaaattgatgaggccgcccagctcgccgacatgtgtcatgcatgcaggctggtagcggtacttgtacagcccccctgtcgagtacgtaatgaaggtacctgggtacctacatgtctagcgcgctgcgttatcgatgacatgatgagcttccccatccaccgctaacacacttgctccgacttctatctagccgtatttatactcgagctgccctgccatcagccgtcgatgcagagctcctatagcccccgcgaccgtctttcaatgcagcgcccttcgacttagaagaagcatagcgagtgcgctcaacatccatctatcccgcccggtcaccggccgaccatccggccacccacttccgcaatgcgtcatcgagtcgcaaacacccttctcacgaccttggcgctgctcacggcatctgtgagcagcgcccagaaattaacgcccgtacatgagccgggtcggtgcgccttccgcggtcactgtgggaagcagagcttttttggcaaagagctgccctgcgtcgataacggcctagccaaggatcccgatgaggagtttcgcaaggagcttgttgagctctgcggcgagaaatggagcaccggacctgtgtgctgcgagctggatcaagtatgtatttgagcgcctcttgtagatcttgtagaggcggatgcaccaatgaataccatcgactaactatttctcaggttcgagctctcaagtcggagctgggtacgcccaacacgctgatcggatcctgcccggcatgcaaggagaacttcttcaacatgttctgcacgttcacttgctcccccgaccagtctacatttatcaacattaccgattccgctgccaaaaatggcaagcaactcgtgaccgagctcgaccaactgatatcacaagagtatgggactggcttctacgacagttgtaaggaagtcaagtttggtggttccggaagcaaggccatggatctcattggaggaggtgccaccaactatcacgatatgttgaagttcctaggagacaaaaagcctctcgtcggctcgcccttccagatcaactttccggccaactataccgaaccagacatgggtcccaaggatatgaagccgaagaaatgcaatgacgaggatccagcctatcgttgtgtgtgcgtagactgtcctgaggtttgtcccgagctgcccgcagtcaaggacaatggcgcctgccatgtcggcgtgctgccgtgcctttcctttgcgtccatcttggtttattcggttctgttattcgtatttaccaccatggtctttggacacattgcctggaagcggtactccaagcgtcgggtggaacgaacaaggctgctacacgaatcatcccacagtgatgatgaagatgaaggcgggcctgtgctcaccgaagccatgcgcgatcgcccgacgaagcgttatcgcatcaacgacatctgcgacaaggcattctaccagctgggccatgctgcggcccgattccccggtgtcacaatcagcttaagtctggttcttgttgctctgctcagcgccgggtggttcagattcgatttggaaaaggaccctgcacgcctttgggtcagcccatcctctcctgcagcacaagaaaaggcgtactttgaccagaactttggccccttttaccgcgcggaaaaaatcttccttgtcaacgacactcagccatctggacctggtcccgttcttagctacgagactctcaaatggtggatggatgtcgaaaagagcgtccaaagactcgaaagtcccatctttggcaagtatcttagtgatatttgttttacgccactcgatgatgcttgtgtggttcaatccgtctccgcctatttcaacgccaagggtggcctgagccccaagtactgggaggatgatctccgacagtgctccaagtctcctgtcgattgtcgccccgattttggtcaaccaatcgaaccaagcatggtgcttggcggttatgatgacgatgtcactcaagcacgagctctcaccgtgacatgggttgtcaataacgcgaacgagggcagcaatgccctcgctttcgccattgactgggagaacgcgcttcgggatcgactcctccaggttcagcaggaggcagctgacaggggtctccgcctctctttcaatactgagatttcccttgagcaagagctaaacaaatcgactaacaccgatgccaagattgtagtcattagctacattgtcatgttcatctacgcctgcatggcactgggcaccccgctcaagcatgtcttcagaaaccctgcggtgttgctcgtcgagtcaaaggtcactttgggactcgttggcatcatcattgttctcatgtccattgcggcctctattggtttcttctcctgggttggcctgaaagcaactctgatcatcgtggaagtaattcccttcattgtcctcgccgtcggtgtggacaacattttcctcatcgtccatgaacttgagagagtcaatgtcagctgccccgatcagatggttgaggagcgcgttggccgggctttgggtcgaatgggcccatcgatcctgttctctgccctgacggaaactgtggcattcgctcttggttccgctgttggcatgcctgcggtcagaaattttgccgcttacgccgccggagccgtgttcatcaacgctcttttgcagatgacaatgtttgtttcattcctttctctcaatcaaatgcgggtggaggatcatcgctgcgagttatggccatggtggcaaatcaccaaagcccgcattcacctgaacggatcgaacggttatgctggatcgggcaggacctctgactatgacgaggaaagcttcttgcagatcgtgatcaagaacagatacgccccagccctgctcaccaagaaagtcaagactggtgtggttgttatcttctttggtctcttcgctgccagtcttgcattactacctacaatccaacttggactggaccagagagatgcaatcccagatggctcctatctgatcccatatttcaatgatctttacgattatctcgagataggaccccctgtctactttgtgacccgaggtgtagataccacctctcgtccagaacaacaagagctctgcgccagattcacaacgtgcgagccactctccctcgccaacacattggaacttgaaagacagagatccgaagtttcctacatctctactccaactgctagctggatcgatgacttcttcacgtggctcaatcctatctatgagaaatgttgtgttgagaacggtgagacttgttttgcaaatagagagcctgcatggaacacaaccctccacggtatgcccgtaggtgacgagttcatccgctacctcgagaaattcttgaccgccccgacaacatcagagtgtccccttggcgggcaagccgcatacgggcaggcagttgttctcggtgaggattataagagtgtcaaggccactcatttccgaaccgcccatacccccttgagaagtcaggaggatttcatcaaggcttattcgtccgctcgacgcatcgcagcagacattacggcccgcactggggcagacgtcttcccatacagtatattttatatcttcttccatcagtacctcgagattgtcagcttgacggctggacttctatccgccgtcgtaggcattattttcgtcgtcgctgcgatccttctgggctctgtgctgacctccgccgtggtcactcttactgtaatcatgagcgtcattgacatcatgggtgccatggccctctttggcgtctcgctgaatgcggtgtctctggtgaacttgatcatttgcgtcggcatctccgtcgagttctgcgcccatatcgcccgtgcgttcatgttcccctcccgaaccgttatggagagcaacaactttggcctgcggggccgtgacgcccgagcctggacagcacttgtcaatgtcggaggttcagtcttctccggcatcacagtcaccaagcttctcggtgtctgcgtcctcgctttcactcgctccaagattttcgagatctactacttccgcgtgtggctggctctggttatttttgccgccatccatgcgcttatcttcctccccgtcgcattgagcattgcaggaggtcagggctacgttgaccccgagagcgagggaacagccgcccaagacttgaccgatcgacgctggcgagcgatccgtattaacgatcaaagtgactcggaagatgagtactagttaaatacaagagtaaactatttttttggttaacaggagagcctttttttttcttcaaatacatgggatcgtattatctggtttggtggtgttgttgttcaatacagtttgccattttatcctcgttttaagttgattatattttacttcggctcatgatgttcaactagtatagaagtaaaataacatatttccatcaagttatattccctttgctggtcgcagtgttgatgcattctatcatacttttctttcatatgtctatcatgcgaaactaaaggccccaatttatgcgggaggtaagaacgaggcatacaaaatgccttggatgccagcgtacatgaccatgaatacggtcactccccatccaaacttctgggtttgtttgtccatcaaacacctcgcgatccaccaataccaggggatgtagcccgatgagatcctattgataatctgcacgtggtacgaggtgatggcgagcacggcgacaaaggcctggctggcggcgaggacctggacgaacactcgaaactggggattctcgccgggggacacaacaagcgaagggtcgcggactagcttgagtcccgacgcaatgaggaggtagaggaccggcgcagcaaggaggaagagtgggatctggttcggagtccagtatctcaggaaccccacgttcctacgtccgccttgttagcttgcatactacctgagtttgattatgtttttccttaccagtaatgctcctggacgaagctgtagatgctgggaatcgtatttgagcaccacggccttggatcgaacccgttctcagggctgcagtatatactccaggccctggcctggggcacgatggatcccgaggcgacgagcaagccaccgatcacgggggagacgatggtcaggagggaggtgagcgaggggctctgcaggaacgcgtacgcgcaccgcagagcctccacggcgaagagggagccgtttgcgaggccattgctgcggaacctcgtggcgagcccgaacacggcccccgcgctcaggacgtggacgttccgcccgctgctgtccgactgggcatagctgagggcgaagaggtagctggccacaaaggacaggcaggcgaatgtggcttcagcgtatggcgaggagaggaagagcccggcgggagagacgatgtgaagcacggatgcgacaaaggcgaagcggcggtccctggagaggagcgacgtgagctggtagagggccacgacgctgatcaggtgcgacacgtgagagacgaggatgcccaggagcggctcgacgatcgaatcatcatggcagacacccgtcgaacagagcccgtgacggagcttggcgatgagggcggacagcgcggtgctgaaggcccactcctgctcgtagagcttgccccccaggcgggcggcatggacgtagtagagggcatcccaacgggtgagcgtgcgggcgaggacggggacaggggtggtgccggagtacaggttgtggaagaagagcgacgtggacgtgtcatagtccggcgcggcggacgcggccagcgcgatggccaggaggaaggccttccatgcggagaacaggacggcgagcgatgcgaccggcctggcgtgggggtcgacgagggccatttctggcggcaccgtgatgctatctaggagttttgggttgagcccgtcctggcagaggcataagcgtgggcgagatctagctcatgcgatctcagaacattcgatgcgtggtcgcggtgctataattaggcccgcggggagccgttgcaggggcctatttgtggttcgcatccgtctgtatcgatacggtttacattgcaacaactgctggtatagtggttgaagtcaaggaaaatcgagctattagtaaattgtatcttgatttggaacattgggttatcggattgtgttgaccaagtgcatgcccgattgggtcttgcgaattatctaataacacgaaaaacgagctggtgaagttattagttgagatcctaaacggtcatgatgaggttctatcctcagtcacttcgcaaatacacacagcaagcatctactgtagcacacgaaaaacaatagcagccatcttagattagatcttaaattagatcataaactccaatctgaacatttgttctctggtaaaattggttatgaatcgtggtgttgttggaaaaaagccttatagggtatcacaatgttgacggctatagggtaggtgatataagcgatccaccatgtaggtatcatgtcaagcatgtttcaggttccgaagtgatatacctggtcattttattagccgtgattactctggaccaggcagggctggtagggctctttttctgtgctacgatggttacatcgtcgattttagggtgggaagaaatctcagcttgccgatccagtaagcagctcggttgacataatttcattttattcatacgtattactaccagttaaattttctccccagtgaggatgggctgagcctcgtccgtcgtccaccagctgacgcccttctcgccggggtatgtatatcggtccatactgtcaggcttcatctccacactgtagccaggctccgtcggggtctggtagaaaccgtccttgatgacggatgggtgcaggaagtgctcgtgcaggtggtccacgtactcgagcactgacagtttgccacttaccacgacgtaatcgatggtgctgaggtgctgtgtgtactctgggagacccacgccgccagagtgcggaacgatggggatgttgtactttttggcgattaggagcacggccaggacctcgttgacaccgcccattcggcaggcgtcgatctggcagacgtcgatggcaccagcctggatcagctgtttgaagatgacacggttctggcacatctctcctgtggctacaccgattccgtatggcttgagtgcgtcgcggacggccttgtgaccgaagatgtcgtctggcgaggttggctcctcaatgaaccacggcttgaactcggcgagctgcttcatgtgctcgatggcctccggcaccgaccacacctggttggcgtccaccatgaggatgttgcccttgtcatagccgataacgtcgcgggcaatcgtcagtctcttgcggtcatcctccacgctgttgcccaccttgagcttgaagtggcggtagccctgactgagcgtctcctgcagcagggccttcatcttctcctccccgtagcccagccacccggcactggtcgtgtatgcggggacggcgcggctctgcagcgcctcctcgatccgggcggccttgccgggctcctgctccttgagcagggcgacggcctcctcgggggtgatggcgtcggtgatgtagcggaagtcgatgcagcgcacaaactcctcgggggacatgtcggcgacgatgcgccagacgggcttgcctaggaccttggcccagagatcccacacggcgttgacgacggcgcccagggcgaggtggatgacgcccttctcggggccgatccatcggagctggctgtcgttgaccaggtggcgccaggtctgtccccagttggcgacgagggcggatagcgacctgccgcggaggcgctcggcgacatgggcgattgcggcgcagacaatgtcgttgcctcggccgattgtgaatgtctatgcggactgcacgtcaggaatatgagctggggaaatgggtgagtgagagagcactgaccatgccatgtcccgtgtagtcggaatcggtcttgagaatgcagtatgcggatgagtagtcaccggctgcattcatggcgtcggatcccgtcttgtcgagagacgtcgggaaccgcacatcgcgcgttacgaacccggtgattgtgatttcagccattgtggtgagatttacaagcaaacccaaaggatgggctgatcaattactctgctctgagggtgggtttgagatcaagtgatgggaatctacatgcgagcctgggtggcacgtggggaacgaatttatagaatgagagcaattgaattgccagcagagaagcagctgcatgccagatataaagtaaaaaccatacatatatcatcatctccacgcgtcggcgtttggccgtaccggattcggagaccaaaagtcgcgatgcatcatccgacgacggacagtggagccaagatgggtgccgctcaggaaaataggaggaatctggatgctgattgatggataaatcactgttagtgcggtgtttggtgcttcaatggggacctcgacggataaattctgggggcagaaggtctgaaatatcccgacggcatttcaagatgttctggaatggtcttctgattaaaatctccgcagagtggcgttcgcgatggcttcaaagtacacttgaaagtacacttgtaatcaagacgtgaaaaagcctacggaatcatttcagaaaccgcagttgttctgcttgatgaatcgcttggttgtgcttgttgagagcccctcccccactctcccctcatcgacgtgttgatgcccctcatacgcaatattaggtaataaatcaggtaccgctagctgcaagtgttttctggcctgtgctcaggcgagaagagccctggacgttacctgatattatgacccacctaaatacctggctagcagcgacatgagatgtaagacatcatgtttttcaaaaattaccacaaatgaagaacatgggatggctgcagaaaatattgcttttcatttaatctccatggagatatatccaggttcaataatcataatcgagctaaatcgcagcgtttccgtgtcgcatgctcacttgcctggtccatacggagcttagtaccaatggtcattagatattgcgggtgagtggcgagtggcaataccttaagtaatccatggctgccgaactgccttgggatgccggtgcttggcggcttcactaccagctgcgagtcgcgtataggacccatcaccagagcctggcccgcaaggcatgagccgatcgcagatgtgggctagctatgttgatgatgcatggatgttcaaagtaaaatgaatgtattttcggtttgcttatcgattggatattttgaggatacatgcgcatgggcttatctaattgggcaagtcctttgcttgctggttactaattggggctctccgaattctggggatcttctatagtaaaaatagcatccttgcgtccaagaacgcaataggcagtaattttctagaaggcttatggacgaatccgttcagctgggaggagaagttcgccaaaggtcaattggcgagccaacatttccccagtcgtagatgctaacaagtcgccttcattgcgattctttgccggatggtcaatttactgattaattgtcctgttgcaaaaagcaagacgtgtcttggtgccgtcattgcccacaaaccgttctggtgggtcttggggccgtgcgctgaacacaccgaaaagggaccagtcaacaagtcttctcagtttggccgccgtcctccagcggtttgctcactgctggccctggatgatgaccctgctgctggcggctttccgtagctttgggcgatcaagcacgaggctctcactattctagggagcggtaagtgggtattttccgtatgcgtctcgttttttggcctgtgtgagtttgagaaagccgtggccatcaccaagatcacccttgtcctccgcgagatgtggcaaaattcgagattgctactgctagttttgggcccgctgtccatcttcatctcctacaggcgactgaacagcaggcctggacggaggcatcgattgcttagtgctttcctggcctgtttggctcgctacgggctgcgtgcatggagcaattaccgtgtatgtgtgcagctgctcgcactcgtcttagatgcttaggtagggagacaggacgagatcagtgctcaccaatagaagatgaaaaaaaatcaaaatcaagctggttgtcttagatgccaatcaagaatattgtttgccgtataataacttttccttctcgcgaatactgtccttgacttccaagctctcacaacaccatccatgaagcatttgtcgacgccctattctcagctctgacagaatccatcgcgcagcggcagttgggatacttaccgattgagcgtgtacctgcaggcgagccaggtaccttgtttgtttacatccagggctgtggctatctacagcagcatttacagggctgtccacgaacggtctcccactgacggtcggcttcagtcagcatctggggccagggtccggggtctgacgtctccataacgggccctccttctgacggcgctctcaacaccacaagccagttcacacccaatttcgctgtcgagccgagcatagtcgggggtcgcagctcgaagctcagcagcagccttacggcctgtgcgctccccagttttacccattctgacactgaccttgcccttgggtctgttgttttggtgatccggacgcatagctcgacccaaggtgagcgtccgcggccgcacggtttggtctctgggccctttttttagagtcatcgtgaacgagcgggccagagcatctacagcagcttcgtttccataaaggcacctcttccccagcccaacatcatgagataatccagacatacaacaacaataacggtaacgaacaatttcctttggtcttttcctttggtctttttcctttggtcatttccttatttcctttttgtattagatagaattgcatcaagctatttgatatagctttttctttttgtttgcacttcttttcttttataattttcattttcacattcagccaagatgctccgaacatcgccacgcacaaacaacaagacctcctcgccccgatcaagggcttggtggtccaagaggccttccgaggacaagactgctactccttctccagagcccagcagagctgcccgctctgctcgaccacagcgacgaaacagcttttcttccagatacagccctgtcaacgacccaagagtggtgagctttctcgagtctaatgctctcgtcactgggcctgatggagtcgtcgtccgccctcctcgccacggttccaagcccctcgagattgagtctcgatggaagcaggttcactctcctcccacccaggaggttcagggccttggccttacttcggattcctccaaggaatcccgacctaatcttaagaaacttcaaatgctggtcaagatgcccagcttctcctccaagaacaacgcatctcccaagtctcctcaccagaagtcccgatctgaagacttgaggcctacatggcagactgaagactacaggccacgaccttacgatctcaggccttatgatgctatcaagccccagtctgaggagcccaagcctcttcctctcaccaggaagatgtctaaccttgatgagctggcccagcgctaccagaacatgatggaggttcgcggtgagagcaaggctcttccctcgctccccaccccccctacgactccccctaccgagtctgaggagccccttctgcttctgccccaagcctattccggctccccttccacttcttccgagtcccagtatgagcctgagcctgagcctgtcctccgaaagtcgcgtgcccagcgattcggagccagtcttgaatccaagaacctcaagcagattgacgagcagggcatccaccctctccaggctcacccatggaactacctgtacgaggccccccaggctgctgagatccgaagcgacagtggcagcagcaccgcttccgaaggcagctccaggacattcagcattggcagcctctcccctcagtccgatgtcaccctcgtggccttccctcaggaggacaacatgcctttcaaggaggatgccatctacttcaagcctgtctccttcggccctacccctcctgccactcctccccaggactacaagcccagtggtgcattcggctctcccgcaattggcctcggcatgctggctcaggacatggtctgctctctggccgatgcttctcctcgagctggcaacaagttcgacaagatgcaggtcgacgtcatgattgagacctacgagcgcctccgcgacaacatggccaccatgggcgtcagccagcaggagatgggcaacgccaaggctgtcttcgactgctggctctcagctctcaactccatccgctgcgccatgggagaggacaacaacgagtgtgcttggatctaaaaagtgaacaacacaaccagtagcggtgtcgaatcttctgctacatgcaaagctgggaacgaacgggatgagcgataatatttcatttccttttctttttcctttttatcttctttctcatcttctcttctttattggccacaatcgtctgggacgacgactggcattcatacattaagtccccaggacgggatatttccccaagcagggacactcattctacgattttctttttctttttctttttcttcttctttttcttttgtcccacttcttcttctacttcttctttttcttcttcttcttttcatgttcaaactttacatacccacgatttcttttcttcagccttttcttcttctttttctcttcttttttgagatattctcgctcacccttcttcttcttcaccactaccagtgttttagtacactttggaccggaaaattgtgcgattatgtatatacccaatttcctttgtcgagaagcgaccttttttgcattttcattttcttttgtcaattggagcttttggtttcttttgtcggactgctttctagcatatggcgcccggatataggcagccaagaattagcatagacttatgagaacttcctttgtcacttttacatttatggttccaattgatgtgcatgtatcgtaaacacttaaaagctaatggtttcacataaagtaaaaagaccaagcgcatcgatcggtaagagattggttgattaattcccgagggaaggaacttgagttgttccagagctgtgggggcggaggctgataagtgataacggtctataataataataataatctgacgtctgtccgtgaacgatcttccatctcgtgtttcaggcgctgcttcctccgacccattgcaccttggaacggcgcccgaggcacggcgacaccgataaacgagcagctatggaggacgaatttggcgccgacgactccctgctggaggccatggctgctgcggcggaccgggtgtcgtcgcagcaatccagagttggttcatcgcagcgagccgtgcaacagcctgcgcctcagaagatccagcagccaaccccccagcgactggataaacctccgccgacgagctcttcgggatccaagatcgtgcagccgacaccccaggcgctccctcagaggggaactgggtcgcacattctcgtctcgccgcgccagaggggcaatccgatcttgaccttcatccgtgctatgggttgggagtacagcgatattccggcagactatgttatgggacagactacatgtgcactttttctgaggttcgtaaatccgggggactggcattgcacgtatcgtgccatgatgtgagactgaccgtgagcttacatagtcttcgttaccaccgactgcatcccgaatacgtctacacccgaatccaaaagctccagggcaaatactcgcttcgtattctactggtcatggtcgacatcccgaaccacgaggactcgttgcgagaactatccaagacatcactggtgaacaacatcaccatcatcctgtgttggtctgccgcggaggctggtcgttacctcgaactctacaagtcctacgagcacgcaggtttcactgcgatcaaggggcagcaggcaacaagctacgccgacagactcgtcgagttcgtgacagtgcccagaaacctcaacaagtcggacgcggttgctctcgtcgcgaacttcgggagcttgaagaacgcaatcaatgcggaccaggagcagctgagcatgctcaacggctggggaggtgccaaggtcaagcgatggtccaaggcagtcgaggagccctttagggcgagaaaagctaccaagaaagccgtgcgcaagccgccggctggaggtaacgttgcccagaatgcagctcgtaatgcactccttgaagatgcaattcccatctcccggacgatgcaggcagactccaccccgggagcttcgaacccctccaaggcaggtcagttccagctcatgggcgacctggatgacgatgacgaggaggaggaagcaatgctagctgcagctattgaggagtcgcgccgtgcagctcaaccaggtccttcggtgcaaccccagcagagcgaggagagccaagacaaagatcatttgagcggaggcatcgctgctgctctggcgaagttgagggaaggcaattagtggttgagcataatgcccgagcccacacacacatatgcacacccccttggagccggctggtctcgtgaatgacttagagccaaggaatcttgatccgccgcgaaaataccgagacagcgcccaacccctcagtgccggaccatggcctggttgctctccgatttatcggggcatatgctccaagttccggccagaaggagttcttgtgagccccaaaacaagtgccgattgggttgagaaagtgcatcagttggagcccacgataaggaccatggctgtccagtctggacaaggctcatcgcatggatcaacagactcgcaagcttatactttgaccgtgcatttgaccggtgcctaccaactacaggttgcacagcatagaagctgttgcattggatggcaccttgcaatcagggtggtccgatgagcatgtcacttgcttcttcaaggattttgtctttaatgctgccgaagctgggagacggtgcggggagtcgcatcaggcacttgattgcccagcgttcggggctgcagggggacgaagtcaatcatttcgataatcggcaggcggctgcagggtcacatcaccacccattgccatgacctaataaggaggttgcttacttggagcgatggcatcttgtcacatgggtgaaccttgacagccagaatcccccgctacactgctccataccgccgcatactctcatgcccgatgtgcgccgcttttccttccgcagggttggcttttcactgactgcggtgtgattgggtaagtgtgcgagaatcgatggttggttgagccttcgagggggacgaattctgaggagcaaattacagcattttgaagccaaaaaatggttagacggttcatagtacgataatcggcggttaataaacaatgagcgaaaatgggcaaataattctttatatctgatatcttttttgagctttgctgaatgacaccatacactcttggaggcatatcactgtggtcacggtgacactcccgcgatccctgagggccgaatccaggcaccctcgggattacaacatttacctcttcttcacacctgcctgatggaaccctcttgcagtattttgcgtcatacggcattgatgggggatctttcgttcaatcgccttttccccaatttggactcccttgagttggagcaaggggcgtcatctgatgttcaatatgtcttgaagactataaagaccccctgataccctggttggtgtctctcggcttgccacaggtcagaagttttagtccctctgagacctcatctttctctccaggaggccaactgctcatttcattgatccgcacacttcaccaccatgcggtcgagccaactctgtctctcggccttggggcttgcatccactgcacttgccgggcctcagtttcaccaccggcgagatggtagctctaatggagagagagttaaggccgtcaaggaggcttataggacagcgtggaagggctattatgattatgccttccctaacgatacgcttcacccagtgtcgaacggatatgagaacgaccggtaaggaccgccgtgaagagatgagatgaaaaacaaaacgttctaatagttgtataggaacgcttggggcgtaacagcgttcgattccctcagcgcatcaatcattctcggtgatagggagagcgtgaaccaaatcttggaattcgttcctacaatcgatttcaccaccactgctaagtctggcgaatccatctctctgtttgagaccaacattcgatattttggtggtctcctgtcaggtgtgttggtaaccgctatctgtctgggacatttgactgacggcagtagcgcacgatctactcacacaagcgccatggagcgacctggtcgacgacaagtcacttgttgacaaccttttgaagcaggcagttagccttgctgacagcgtgaagttcgctttcgacacccccagtggtgttccagaccccaccatctatctcaaccctgagccgaagcgtgcaggttcctcaaggaacaacattgccgaagttggaacactcgtcttggagtggaccaggctctctgatctaaccgggaaccccgagtatgcgcagcttgcccagaaggctgagtcgtacattctgaagcccaccccggagagtggcgagccgttccctgggttgaccggaacctatctcaacctgacagacggcaccttcattgacagctcaggcggctggtccgggttgacggacagctactacgagtacttgatcaagatgtacctctacgacccggaggagttttccttctacaaggacagatgggttgccgctgctgattctaccattgagtatctggcatcacacccaacgtcccgcgaggacatcaccttcctgtctcagtatcaaggaacccagaccattcccagctcttctcattgtaagtcgaccccccccccctttccgcggtggtctttagttgatactgaccgtacatgcagtggcgagcttcgcaggaggaaacttcatcctcggcggcatcctcctgaacgagcagaagtacatcgacttcggcgtcacgctcgccgagtcctacttcgagacctaccgcgggactgccgccaagatcggccctgagggcttcaggtggaccgacagcaagctccccgtcgacggcaccatcaacaccaacccgcccgcgggccaggaggacgcgtacgccgaggccgggttctgggccacctccaagtactacatcctccggccagagacgacggagagtttgtactacgcgtaccgcgtgacgggcgacagcaagtaccaggacctcgcctgggaggggttccaggccatcacggcggcgacccgcacggggagcgggtacgccggcctcaacgacgtgacggtcgtgaacggcgggttcatcgacaagatggagagcttcttcctcacggagacgttgaagtacttctacctcatcttctctgaggagtcggaggttcaggtgcacaaggaccagcccaacaagtgggtgtttaacacggaggcgcaccctgtcaagattcggggttattaagcctgagtttgcggagtggattctggttagaacatatacagtctctaaataaatgaccaagttattctcacataaacttcttgggatgcaaatcgggtgatgtatttgtgtgaagagtgagcgtatctccttcatgtcgcgatcttgtcaaggccgctcacttgttgcgttcttggaatctctcgactgagtacttgctttggcaataaatacatggcataaccacgaaacgatatttggtattttagacactgcatcgtatgccaagtgtatctgttattcatcaagggccggtctctgcgacggggtatttaacaggaccttgattttcctttttttttttctcctcaatgtgacgatcaccagagacaagccaaagcagttctatctcaaaacacatcaaacacgcagccctccagccagtcgggggcctcctcgcggcaacgaagccgcttacaacagcgcagatccagcaacctggaccccggatattctggctcacgcgagaaagactggcttcataaaacttgattatgggaccaagctgctggatctgttctgtagtaagcggcttcattaccgtggggaggcccccgactgcttgaatgattgtgtgtttgatatgcttaatatagagctgctttgagttatctctgatgatcgttgttattctttctaggacctggccacttgccctgaactagtcctgggtggtagggatgataatatcagatctgatattgtggcttggagaaaggtggttgtgttggtagtggttacgagcttcccctcttgggggccatggctaatttatatatattggacagcccttggtagagtttttcgagatgctgatgcctacgcctaggctatgtgtgttaagttttgacttttcttgatgtgttcaaaacaaactttgtatgatctagtcatgtgtgtagcttaaatttaggatacctcttgcttatggcgatcaaaaaggaatacttcagccctaaagcttaattccattgacatagtgatccatgtgcaatgaagagaaggcctcggagttggaagcatggatgctggggacgattgaggacagcaagggtggatagtggatattgtgaatcagccaatcagacagctgtcgatggctttccttctatcacctttgagggcctcaaggtggcgtttggtggaaatgtggcggtgcaacgcaatttagccacagtgacgtatacagacgccacactgccacttatatcagagcgggatgcgccatcttcacccctctcaatttgcaaacctcatccagaacagaaaagataaacaaaagaataagaagagataagaccgaagccgttacctcaatcatatcaacaataccatcatgggtcttcctcaattcaccaagccttccaacgacaaggatgaccagagctcgcatgctcagcagccgcaacaaggagcggctgtgggtgccggcgccaacacgggcgctggagtgacgcgcgagaaaaccgaggcagagaaggaggctgatcgcctgtatgaggagagaatggaggaggagtacgccaagcgtgagggtggcgcatagctcttctggatcgaactgagaggcctcaatgagttatgaagagtcttgaacttgcattcagctgagttgagagcctatactatggaatatcgtcactcttaattttgaaatataatggcaggttacgctgctctgctctgtgtgtgtcaggactgtacttgaataagctcgtgctctgttgaatggctcatgtccttcaaagtcaaaagataaggaagacggcaagggttgaaatacgactaatgaccattttgaatcagcactagagcagtgaatcttctcctggcagaatagtcgtggcggccattgcatacaatctcgctcttcagtttctcaatagtagccaaatgcgtcccgcgagctatgcgatcaagtaatcaaagcagatatttcacacagtttagaaagttcgaatatagccgttacctcgcttttatctaggaaaccttactgcttggatggagtaagacctagagagactaagattaggatcaagaggaataatatagtaaattgtacttgtgtgttacatagtgtaggagttccacactcgcccaccccctactgtctttgcaacactccgttcttttcatccttagctgttgccagctgacatgtaaacgcacccttgcgaccagctttcttgggcgccttggcgctcaagtatcaacttactatttgtcctatctccatggctgaaggatactaaatgccggaaattgaatagttaccgccaatgtcattcatacgcttcatatggcgcatttcgcgcatcgagatcataatctcccgttctatgcgttagcactgttactttggaatatcttcacccttaatttggaaacatgatggcggattaagccgttgggggatatgagacgaccgatgtaagcttcctgaaatgagaagatgagtgtcaaatttgtaccaacacgcgttccacgttccaacaccaaaagagaattatgtcgcgaaacctatttccatgcggacaaaaccgaaacccgctaactctttgttcctatgcccagccaccatcatacacgtctcatatatgctgtagtaaagacccaagccaaggctatttctcaaaatgaacattgtccgtcaaatactccttctcgattatcacacacgccgtaggacgaagacggtgctctgccaccatcctccgaccggcagttggtttgagtctgccaaccgaccgcccatttcagatttaaaattctctgctttcgccgatatcacagacgtcgaagacaccctcttcagcaatctccctgcgcttcaacgcctctttcaagagcttgggtggctccaatacatcttcgctagttagcgcccaagtgccccaatggatacccatggcgcgtttgcattgtgtgtcacggaagatctctaccgagtcaaaggggttggcatgcatgcctgaaaaggcagcacgggggtggtaagcgccaatggggatgagacccaggtcaaacgggcctcgcatatctccaatctgcttgaactgtgggcagcggggcaaggaggcaaactctggcccatagtcgtcgacgccctcgggcacaaggggaacagcgcggtagcctgtgtcgccgccgaaccagacgctcttctccccggtgcggacagcccaggagcaccacaaggtggtgtccttgtcaaatgggctgcgagcagatgtgtgttggcaagggaggcaagacacacgggccgttattgtcttttccttgtcttcctctccatctttcacggtaatggtcagatcggcgtcttcccaccaatccagctccgtcacattgtcgatgcccgaccttcggaaccacttttcgagcccgagtccgacaaagaactgcaccttgggatggtatttttgaatctcgacgactgaggggtgggagagatgatcgtaatggctgtggctaatgacgacggcgtcgataatggggatgtccttgagctggcagggaggctcggtatatcgtcgaggaccgatcaaggaagcaggccatggagagcagcaaggctcaaacacgggatcgaagaggacgcgcacgccagatgggaactcgacgtagtagcaggcgtggcctagccaggtagctcggatcttgttctcggcttggccggcttcgcgattgggaagccaactgggcttgacgacgggtacagtaggaggggtagtgtcggggaatttcagatttcccgtgagtcgtgccctggggaggattggattagcttctcgcttgccatcgcatgtaatagggttggatgctgcagggaggagacgtaccatataacatgcttcagaacatcggggtccttgtatgatgggtatgggtttttgaagcctgtgacgactcggttctttcccttgacgatgtggtgggggttggaggctgcatcttcgggaatggagctgcgacctggaattttggagacggacgtggtgtatgaggcggtggccattgctgccgcgactgctgccggtacaggcagctaccttaccatgcagatacggtgcagtgatagctggtacctagcgggagtcagatggctgggagaaaaatagcatgaacaaagcgaaaggaaacgagagcgagataaacggaagagggaggaggaggttaaaaaagaaccagggccggcggagagggtggggggtgagaaggacaaggagtcagcgaggccttcgcgccgcagctgcgactatctacctaatatattgagggcgaagtggaatgttggccaggcttcactaaccgactacaggaggtggcacagattacggtgggatgcggctgcagtttgatttctttttcctgtgccgtggcgtgcgtcgcgtgcgtgcgaagaccagtgatatgtcgcagagacgatctgtatctttttcttttctttgtcctggctgccaaccatccattctgctgcgaatggagttggagaggcggcctcaactgcacccgtctccccacaaatgcatgatggcaagctgctcagttcagctcgctactagagccagtgatccacgccctgattcatgggccgggggaggtccgaggccatgggtccagcactcccctgaggcatctacagtattacgcatgacggggagtcagtattcaccgacgcggcctgggcctgggtccgctatctcctgccgagacctttgggctgatggccatggcgatgacccccggcacagtggctgggtaatattgcagccacggacagtgatgcgatgtgacagtgagatgagcacttgttccttcgctcgcctgtttaaggcaggaagctagcctgaaactccctgcaacaaaacccaccgcggccccgtcgccaatgtggtgattggcgacgcaattccagtattatgcagggcctccacgtggagttatgcacgttatatccacctggagctcctggtgctccgtgctcatcctctgatgctctgggctggatgtaagaggtatctccgttctggtcctcggggctaataaaggaagcaggttgctgcactggaccttttcaggaaaacaggagttcggggtatcaatccgcccacgatggccgctcgctccggcccatccgctctccttccagacaagagaaaccaacgttcagatggacggacaaacgcctgggaatgcaaaggcgacaatgacaagaaaccatggaagtcaacagcaacaggcctccccacatggcccaaggcctgtccgtctgcgacgagtcggcgactcatgctcttcccctgctcccttgcctgccccagtttgtcccggccaagatacgagtagctgaggtaaggtaaggttgtagtcagtacctgaggtacctgatctggtcatccaccgacgacacgacgttggtgtagtactgcagggttttgagtttggtattaataagcgtagcaacagcaaattactatgcaagtttatatttggttgatttggttgatacagataggttttttgaagtagaaattcctttcgtcgagatattgagtatctcaacgataacgcggaacgaacccggtagtggatcgcctaatttcccccatcgcagtggtcgctcgtctcgactgcggaggacagagagcaaccaattgttgctacggatgactgctgggctaagtctacggtatcccaggggtgttgacaggagcatcagctagaaatcagccaaaagagggaaaatgtcaaaacaaactacaaaacttaccaattcaagcgcatgtcaaaattggtttcatttactcgaatgagattgatttgatgatgagaggcgatgctgaagcgagccatggaagcacgcgacttgtcggatccataagaccagaccacggtcctttcagctcccaactttacaatcacagaggccaaggtcagggggcacacggtgtgactagaaaggaagtagattttaaatatattctaccatggtaaattttggctcaagtacattaatcttcccctcctcaaatgatctagttcgtgatatcacttttttaaccctgcagaagactgcccttatatagcaagagaggcacggtgcacaaaccacaacagaaagaaacaatcacccaaaatgaacaagaagatgcagggcaaaaagcaagagagccgggcctctatgtatgcaatatgaactccaaagactccagaagacgaatgcttcgcctcgtgtccgtcaaaagccgtggctagttttttttgtcaattactttcagggggcctgctgctcagggtcctccagcctcaggaaagacttgaacagcttcgactccgtgcagtcctcgtacgggtacccgatgtcctgcaggaacttctccagctcttcgacgtcctcgtcggggcagatgatgccagtcaggcatttacccatgtctcctcccgagttgcggtagttgaacagactgatgttgaacctgggtcgcaggacctccaggaacttctccagcgcgcgggggcgctcggggaagttgaacatgtacagcctctcgttcttgacgcccgagacgcctccgaccagatacctgatgtggctcttggccagctcgtcctgagacacgtctgtgacctccatgccgcccgcttggatgttgtccatgagacgcttgagctcttccttcctctcctggggaggtgcgagcagagacagaccgaagaaaacgttggcgatgcgatcggtcgcgtaacgatacgaaaactcggtgacggggttgcccatgatggtgtcgacgagctcggcgaaggcctgcggccgctcgggaatacggacgtggagcagggcctccttgccgcctccaatcttggcgcgctcggccacgaatcggaatcggtcaaagtccatgttggctccggaggtgacagcgatcatggtccggctcgggtcgcggggcgggttcttctcgacgtacttcttcagaccggcaatggagagcgcaccggcgggctccagaccactccgggtatcgtcgtacatgtccttgatggcggcgcagatctcgtcggtcgtcacctcgaccacctcgtccacgacctccttgcagatgcggaaggtctcctcaccgacggtcttgacggccgcgccatctgcgaatagaccgacgcttggcagcacaatgcgcttgcccgcctttagggactgcacgagggcgttcgcgtcgtaggcctcaactgcgatgatcttgacatggggagccatgcgcttgatgtagaggccgatcccggcaataaggccacctccacccgcgcagcagaagatggcatccaccttggccatgttggtctggccgaaaagttcattgccgatagttccctggccagcaatgacatatgggtcgtcgaagggagggatgttgatgagcccgtcgatcttctccctccgcgagcactcctccttggcggcgtcgaaatcggcgccgtgcagaacgacatgccctcctaggcgggcgacgttcaggtgcttgatggcgggggtggcctcgggcatgacaatggtcgccgggatcctcagcttgcgcgccgagaaagccacaccctgggcgtggttgccggcggagctgcagatgacgcctcgccagctcttcttcgggtcgaggtgggccatcttgttgtaggcgccgcgcagcttgaagctgaacacgggctgctggtcctcgcgcttgagcaggacattgcactcgaggcggttgctgaggttgacggcgtgggagagcggtgtcagcttgcaggcttcgtagatgcgggatgtcgcgctcgcaatcaatcgcagatactggaaaacaattcttgttagtcgaaaagccagtgggaaatcgaattgggtctcgcaggagccaggacgcgggaagaactcacgtccgggtggccattgggcagcagaaagtcctctgggacgatttcgcggatgtgttggcgcttctggtcatcaggcgttgacggattaacgctgtagtccgtcagggccatgctggtcctgggggttcggtatttctgcgacattgggacgggattgtgcaggttgttgatttctaccacgccgtgagggtcgccgttggaaaaagtcacgaaaggatcttctagaccgccgctggtgttttcaattggcctggcgccggcgtcggctccgtggccattgactcgatggccatttgctccgttgggctccgaagtcgcgggcgccagctcgtacactgcggaaggcatgttggcaacgctctccagctcccagacagacacgaagtcgttcaatgtctggcaaactgcaatctgtctcagtgcatattcatatacaagaaaaacaaaaccagcaagcaagggcgtttcaccagtcacagacttgccgaagacggatttccaaattttcgataaggtaagtggagcggcccggccgataatggaggggcagctgcagaaccaggggttttgacagcctaaccagcgcgccggccgagtttcagggcccaatgttagagcaatggcaacctgctgccaggcgtttgtttctacgagcagcttgtgaggtctcgcgggtctgtgacggttggcaatgaggcagcttgttcctcagtcaccccgctctggccgtgcggaggcctcgacggcaactccatgacagccaatgcagctttatatgcttcatatttgcccagaacgaaccgaacgaggtattattgtcccgagcctgtctttctgcaggagatggcttggtggcaccgcctagatcggtgatacatcagtttgatagggcagcagtacttttggtcattgcttggcctcaatcccggcttactttgcgcattttctccacacctgcaccaacaccaaaacaaccaggcacatgcctctcgagaacttgggcatgagggtcaccggccggccatattgacggccactttccttcctaccatgggtaaagaatgcggaatgtggtctcggagtcgacccaaagtagcgtccggattaccattgagtgcccatgccctgcttccctctaccctccatgattccagaagaatcccagtctgccgggtgcctgtctcgttcggttgcccgtgattcgtccagcgcatataaaatgcttggccaaataggacacttccttttcattccgagtcaatggtctagaggcaagttgaggggagatcttcatccgattcgggtcgtgccatggctattgttcgcacacgaaccaagccagcgatatgcagggcagtgaaaaggcgaaaaagcaaagggggcagctcatggtggagcaggatgccacccaactcctcaccaccctcgagctcctcccaagcaccaaggcctagagtggtacgatggatatttttaacggccaagctgcagggtctacggccaatggcaccctccgcaaagtcggtgaataggcaggggcaccaaccggatgggtgtgcgattgtccgtgtatgtgctatgcgagtctattcgcggaccggtcacattagcgccggcagctggtgtaagacatcaatgtgcgaggtcggtcctggcgattgcgggggcattattggcccgagctgatgggggagccaaggcattaggctcgcagatgttggtggacgacatccgaggtgaattttgacgaagtgcggtcttacgaggccaacttggattcacaatccccaagcgaggtatgcaaattagggatcgtgactaaggaaccaccttgtgtggctcgcttgcaggtggtgagagacggccgttgccatgggccagaaatcacacctgggctcaagctttcggcttctttttggcaatcaatactcttttcttcggattctgaaacattcggaagctctaggctaacactaagcctatgaaacgatcttgtccgaaccccatttgtggcgacttttcagctcacatacttctctacttttgtattcaccgttcagcttcagccatgcctgcaacttccgatgaatgcaagtacccaacacatatgggtcatccttggctgcctgacctcgcctccacctgaatagtttcaatatcggaacaccataaagaagctgctgattgatcatataagctgtgtgaaatctgacaacctcgcacctgaggcttaagcgaagcgcaaccccgagctataggacttggcttaatgttccgagccagctgggataatcacgttcgcctctcgcatacagcagatggtgctcatacacaataactggaggagctatgccttgatttgataaccaaaacgagggaaagaaaagtcgatcgaaggattatcagctatattcgcaggagaggggaacacgacgcctcttatgtatgtctcaggttcccttatcagtgaaccgtctgcactttctcataagccggaggcgcctcctccatccttccgtcaccaacctgatcgacgggcggcggccgtcgaggcagatgctggccactcacacgcgcctgctccgatctcgcagccgggacactgtcggtgtgatagtttcgcccgcctacttcatgcatgagctgctgagtcctgactgatccagaggacactgtctcaggcgcaaacacagctgccgcgtccctccgcctctgcctgcaacaacccccgccgccacggcggcagcccctcctctcgcgtcgcacggcaacccgttccgctttgcgccgacggcgctcagccctcagttcctgtttgagctcgcggcaggacctgcgctgttcggggagggcgccaggcgctgctgcatattgtgtggggtggtatcgctgctgctcgatggctgcgtgggtggtgctagtgccgtaatactcggcgtcccatttgctgcgatctgcgtcttgcttattgcgcaccgtctccagtatgtggttgatgagtcggaatatggccatcgctttgggattcaagggagtaatgtgagcaaggtaattgtgtgttggcaagggctggttggctcaggccggaaaagcctaaatgaccacaatggataaggtaggtatgcgtgtgtgagtgtgtgtgtgtgtgtgaatgtttatgtggtgtcaaagaggaggtttgtaataagatgcttgcaaaagctcactgggtaggtatcttaggatcgtgctgtagagaaatccgacagcaggcctcatggcttctatttatcctctgtatcctaccttacctagagtatctgcagctagcacgatagactatcgttcactgcctcacacgaccaagaagagtaagcgattcgacgtgcgaaagcgagggacttggtaattgacagcgataataagcaaggtcgaatgggattcccgattcggcatttgggagggtgggctgggccaatagctggttcaatgcgccacaccttcattttgaaattcgtcatctgcctcgtcgcattcgcatctcagccacactacacttgacactctccagctctcattggctccccacgccagcaccaggctaccttctgtcgttgtgtagggctgatccggctatgccacccgtaatgcgctcacctggttgggaatcgtccaatgatgaatgtaggcatagacagaaaaccatgtgaaaacgtgcaggctattgaggtgatcgttggtaggtgtatctcgtcatgtgtattgatgcttgctgtgtatacttgctatgcatattctgtatccatgtatgtgcccgtcttctacgtctatcattcattcatccctgcccagttgcgacaactcccagaacgctcgcaataatgcaagccctccaatctgtgtctcgccagtacggccgcggccacgcgagtttggatcggtgaggggatcggggacccgtttagcacgccccgatagacggcttaatacctgttgatctgtgttcgatccggattgatcgatgatgggatttggctcgcccggcatccaccggcctgacccgggtagccactgcgtatcctgaccccatatctcatcgttgggtgtcccttggttacgatagtcagtcacattctctgcagaatgatcgatgccgtctccgtccctcgtcaccactgtgttgttgaagagaccagctccccaccacatgccaaattggccgttcaagtctaccgtctccatcgcagcaaggacgttgtgatgaacccagccgaggtaggatcggcaggactctatgtgcgccgtcctcaacctctggtatgccctcttatttacaacacggtgaggcccagcgctgatcggctcgagatctgtgcaaaaggcgaccaggtggtggaaatatatggccttgaaggtctgagagtcttgcgagcaagttgcactggaatcacactgctcttccaatacccctccgcgccccaggccgtgccagggcggcaggacacctggagggtagacgctggtatcatcgtgaggcgtgttatgctccagactccacccagtggcattgatcactgactgtatcaagttatggccttcctccaaataagatgggctgcccgtgacagagtacaggccgcgctggcctgtaaggatgacgccctggttgtacgtgtacaccatctcatccctcatgtcacactcaacattacccgggatcgagaaatctatatggtatccatcaacataaaggccccgggcattagtcatattgacatccttaagccacttgtagcccacaatggccgccgccaaatgcgctggatcctttgacgggtacaggcttgacgcaacgaatggtgaagaatagttgtcaccagggaagtactggtacatggatacagacgcagaaatccagagctcgttggtaatggcatttttatacgggcgcaaccgcggattccaggtcattccgccatggcacaggtcatcaccccagcctgacgtggcaagaccccagaaaacgcgcgaccgatgagcaaaagcgggcatccagtgatttccatgccaagggagagacttgattgcctcttccaggcttcttgaacctgtggagtttgttgcttgtgctggatagtgcagttctgaatgcgttgtgacaaattgaactgcctcgagccagccaaggaccacccaaaggatatcgtcgtacgcctgatgcggtattgtgagtatatctatgtatgatatctagggaaaggggtctcatacctctccgcggatcgagaggatatcctgtccaaagtaggaaccaaccaactgggagtaatagaatgaaatgaggttttccttggctgtccagtcgttgaaaggactgagatggatcgaccccaatgctttggtcaaagtggtcaatgttccagccatcacagtctcatggacagcggctgtccaatcgttcgccagaggccatgtgccagcctccgagtcaaagtacacctgctgcaggacggctagggcctcgaatgcatcttcaagaacctcaatctccgcctgtggcacctctcgaccgctggaaataaagtcaagaaacgtctccgggacgggctgacagttcctcggcggcggagagtcatagaagaccgggcagtaagggaccttgtcggtggatcttgccagcactggagatacgccatacgtcagacagaggctgacgaggccaatgagcagctgggagagagccatgatgcttgcggagacgggctcgcagaaaatcaagggtcttcgagatggttataatccggggagatgtgcatgtgatcaccagggccagccaccacgcgcgtggttttttctctcacggggaggagagtgtcatgttaccagaccccaatgatgcgtctgtaacccgcccaaggggctgcttagcgccgagaatgggtgctgcgtctggggaaataggagaccaagaaaggagccaaggtaggagatgcgcggggcaggtgtgtaaggaaatatccgtggcccagccgagccgaccagcgatgcaggggaagatggagggttttgacggcagtttccatccaggcaattgatcgttgcggtggaggatgtgcggccgcgagccccacagccatcgccatggcggaggccccttcttgagtcaggtcatcagagcagccgggccgtgccaagagagtatagttctgacattggagggtggtctgggcttgaggcgagggccgtcctcgtgggacacgattctgggttgtcatgaagggtttcccgtcgcattgcagtccatcaggtgcagctctggttgggcaaagtatgtggtactggtgcatggccaagcactgtgcaagtatgcaagccatccgagcgtttactgtaatgggatggcagatctggggaagcaaaggctatctcgcagcacccccgaactcaatctcgcaccaggttcggctgcaacgggcagtgggcattgaatacatgctgaaaactcctgttcggcagtacttgcagaactgcgcacactttgtcgggtcaggtggtggctatgagtagtgatcatcgcccatacgacccctcctctcccccgccacttgtccagatctggaccagctagtggacgaagccccaagtgcccgcatcacctttgacgcgaggatgggctggacccttcttggtagagatattgtcggaatccgccctagtattattaaatcccgaagaactttcaagaccaccaagggtatgttcagttgatactagagatagaaggccgatactctagggtaggcgcgttcctcatcctcatgatccacaataacctgtctttatacgcagcagccgatccagggtctaggatcaccagcaaactagaaacctgcaaataggaatgcaaattgagagcagtcccatgcttggtaaatttccaagcacaatccacgcggtctctgcgaagcgaaaaggaggtgcggacaatctacaggaccttcagccgccgggattgtttcttcagtgttgttgtagaagtctgagccctctgtgatttagtacctaggtaggtgtctatagtatatttctacgtgctagtcagttctaaacggccttcgaggcaacacgtggctcctggcctgaaccttgaaatgcgcatagaccagaggattggttctgctgaaatgattggagttccgcgtctcgagtggctggcgacgggcgtgttctatcgcgtgggtggattggctcttcttgtggcggttgtggctggagcccccaccaaatgccattttagggcgacgtgaggcggtttgtttactttccacccgaaatgggttcagctattattccacctccaattcacttccgctgtatcttcaccaccaaccatccttgtttctttccgcgcatatgctaccacgcttacgctttattacttgcgcacctacagcaaactaggttgcagctgtattatctgtatcgtgtctcctcaatcctagaacacctggacagattcgactaccttaactcggccatcgcgttccattacgcgcgacaagagcaatggaggccgaagctagataccgctctcgcatattgagagagatggaagctaaccgcaacaaccccttcaactctcccccctcctccaccggctcacatggcactgttagcccaacaatgtcttccgttttctcagaccctgacggcgaatccacgcggcggctgaatgaggatattgcccgtgtcacagctcctaggaaattgccagtcaattgggaagccgctcaccgcaagtggcctgagttttatagcatgcccaaaagtcgcgacctgccaatcctcgacgatgacacagacacgagaccactgagccctgaattgaaagagaacaagccgcccgtccgaagtgctaggttcactgtggacgataccacacaagatatttggaacggttcagcaaggacgcgttcagagatgcagcctcgcgcggacaccgagtccgatctctcatcacttatatccaagtcacccgcccgagtcctgtccgtgcccaatggaacaaagaatgcgcgccaacccagcccactttccaagacatacacccgctccatctcagagtctcaccaccagcaacggcgcacgtcgctgacagaagcgcttgagcagctgagagccaattccgcaagccctcgcaatcgcgaacaacgcaaaaccagctcctccccacaaatgtcttctgcgaaatccagcctgacagctgtggctccctcacctgcagccttcgatagccctgggcaagacatgtcccatgtgcgctcattcttcatgcctgacgtctcgcatcttggtgactttgtcaccggcacactacggttcagtggttccatgaagaacggtgtacctatcttcgtcaaacatggcaacgtgcacgatcgtcaggaaaagccccatatgaccagccacgcggatgtggatgggctggaggtgccggaagatgaagagaagatctttgtgtccatggatatgatccgtgaggagatcatctctttgcaggatcactacgaaaaggtacaggagtatgcttccaacctgcagagccaggtggaggcgcttgaggctcagctcaaggcccggccaacggttgagaggcgatcaagctcagaacgtccaaatgagcagcttctgaggcaaaaagagagtaagtttgtatttaatctcacccaagacttgccattgctgacttctgccaggtttggaaattgaaatcacaactctccaatctcgcctggagcaggcctcgcgaaaaattagcctgactgagatagagaaggactctctaatccaggagaaggaccgggcagtccggaagcttcaagaagcttgcgacgacattaacaagctgacacgtaaactcagtgtcagggagagggaactagaaaattctcaaaggatcattgaatctacggagcaacaccgcctggaaactgataccttgaagcgagacctgctctcacttaagcatggtcgggatgcattagagctcgagaatacctctctgcgcactgataatgactcacttcaccaggagaagagagaattggaggaggaaatcgaggccatccgctcggaaaatgagagtctgcgtcgcaagaacgaggctctgctctccgaagccaagtctcttcgctctaataacaagaatcttgcgactgaggacgaggatcttcgtgacaacctcgatggagtgcagcacgagcttgatgctgcgattgagcaagttcagagcctccatcagaaagtagaggagatgagccaagagagaacgacccttcgtgaagacaacaacagccttgttcgacacaacgaaaaatacttcgaggagaataagattctgcgacgggaaaactcaggcttcgagcagagtattcatgctttgcgagatgagaatctaaaactgaaggaagacgttgattttatgaagcaacagatggaccactgtcgcccgattcctaaggaggatctgttggcccaactggacgatgagactggagaaaatatgacatcagcattcttcatccccgacatcacaatgaattccaatgattcagaggcactggctgagattaccgacgccaaggggggacctgttctgccagagcttaccacccaaaatacccgactgtcgaccatccctgatcttacggaggagccaacaaaccactccgaagtcaacgaggaaaagaaggacactcatcaaagatccagtagcacatccagatctcaaaaacaggttgcgaccagctctaaagttgcctttgcaattcccgatgcatctgcccaaagtgtcaagagcaaatcaaacgccaagtcaaatgttgccaaccagggcagcaaacgacgaagcagcaagtcgagccacgcaagcatcatgcagaagtcgccattccgcggaaccgagcctttatccgatatggatgataccacaggcgctgtatcaatggatgagatgacccaggagcagtctgttgatgaggagaggtctcacaaacaatcccgcacagaagagcgctcccgccaaatacaaacattggaaagtcacaaccgagagactcagagcacccgccgaagatcgagtcattcgcaaaatcatagccagaaaatcgccttggaggttgtgagtgaggaccacagaacagctgaaagttgccgaacgctctcgcatgatgctcggcgtgtgttggatggcctttgcgagcacagctgcactaactgtactgtgtgtgctcgtatcgcctcccacaacgttgtcgtgtcgtcgaaagaacttgcgagcggaaagaagcgagttactgtctcgcgcccggtccccgtgtctgatcgcaacttgactggggatcatacccttcggcctgcccaggctcctggtcacgccttagctatggttatcaaggggctggaagatgaatcccatcatcttcaactggagcttacacgtctccaggccaaatacaacggcactgacaaggctctgggtcgtcgcgagaggctccgtatggccgagggcatccgcactctcctgaagcaagtcgaggccaagaatgaccagatttatagcttgtacgacgtcctggagggacaaaaggctgcgggacaggccatgagcgacgaggagctcgagatgacggtcctcaacattactggtatgacggttcgggatgtcaccagtggcagtgagcatctgacctgggagggcattgaggatttatgagtgaaccaaattacaacgatactgcagcagacatttgctgcttggcgataaaagggaacgggtttgtttttttcagggtaggattcaaacatggatcagattgagttggatttcgggcggcgttttggtttgattagcattttgatgtgcattaggagtttggggcggatttcacacctttggttttgtttgcattagggcttcttgtatgaatacggatttgtcccccggatcgagggcgagactgggcttacaagatattgaaaacattgatttccattggcattgtggatttacctgaacacattaagttgcacttgaaaagctcgagctctatctactcttcgtcgtcctcttcctcgctaccctcctcctcgtcacctaattcctcttcatcctcatcctcatcttcctcttcctcttcttcaaagtcgcccgcgttggctccccgctcctcctctctcctcttctgatcctcctccttacgggcctcctccaggatcttggtcttttgcgccctggctttacgttggccgatgacgtacgcgcccaggggcgtcttggcgacgtcgaagtccttgaggaagttctccacctgcgtccggtccttgggcgcaaagtcgacgcgggcccgcttctcctcgatgaactttgcgttggcctcgagcttctggacgaggatgacgagctgggaggccagcttggcgttcttgttgccctgggtcttggagcgggactgcttcagccagcgcttgagctggatgatgacggggaggacgagctcggggaaggcgatggaggtggaccagaggagaaagtactcgccgaagagctcgacgacctgctcgccgacgccgtcctggtagacgcgggtgcggaggtacgacttgggcgccttgtaggcgacggagaagtcgaaggccttgagggtggtggccttggggggcttcttcatctccgccgaggtgaggatctcgagcagaggggaggccagggggatgtaggttccggtggcgcgggatgtgcgcaggagggagcggatgaggtggaatcggagggggaagtaggtggaagttgggatgaggcggagagcgccgagggtgacctggaccaggggatagatgaggagtctgagctgggactctttgcccgcctcggcctccttcagggggctgcaatgctcagcgaggacgcatgaccagaagtcgagtgagtgtacatattgccagttgtaaacgatgcggaatgaatcgttcttgttgttcacaatgctgttgcgaaggtggatggcaagctggcggatgaaggtgaaagcggtggtatatccaacactagggtcgataccccagagctcggcggccgagttcttcatcaggttgatgccctgaatagtgttgtggttggttgttcggcagccctggacgagtccttggtaagcggctttcagaacagtctcgcggattcctttgtcgccaatgaccaccaggcggcggagaacgaggaaggcagtgatacgtgttgactcggagcttgcaggctgagcccagaagttgacaaccgacttggcgagagcctttacgagcttcttgaatgacaaaagataaggtaggaccggctcaagggatgatagagttaacttgagggtgcgatcgtctgatagcgtgcttaacagatgcatgattgaggacgtatatgacttgagaaggagcgagagcgtcctgaacttcttggtttctgtctggacgtagacctttcctgatgacgactccttgacggggaggtggtggttcatcaccgtagggatgtgcttgagtgcgagtgtgaggatgtcattgaagacctccgggctgttgatcttccaccgttgctcagtctcgccattctcatcgtcctcgttgagatgcgcggcgcatcggaaggctagaacaacctgtctggctgcacgcagagagttcttctcctcgattgactttttccaaatggcgacggtctctcgagtgagctcaggagtaccggctggcttttcctctacctcctttgtcttcttccgcttctttttgggctgctcctcttcctccgactcttcgccagggctgagttcgtcgatttctgccaggtcggtgttgtcgtcgaagtctaatgcctcgggatcattctcttgcaagaacttgtagaactcggggtccttcttcgccaggtcatccattgcctgcttgctcattccggctccagcctcatcttcatcctcgcccgcgctatcgtcgctgtcgtcgcccagtggctgttcggctacggacgatccagagtcgtcttcctcatcggatccctcgtcttcgtcggccttgggtccgtctctcttcctcttgccaagcttgggcgacttatcaatgatgtcgtcgaacccacccttgaagaagtcgtcgacactcatgtctgcaaccttcctccccttggatcccttcggtttcgaggcgtcgccatcggcgccatccttggatcccttgtagaactcggcatcctgggcttttcgtgcctgtttcttatccttgatctgatggcgctgcttgactttggcggaagcttttctgttgtccaagactcccttgagatgcttcttttcgaatttcttggtggccttgaggttcttcttaacaggacccatggtgtctcgttttcctcgtagagcaccagttgttggtactcaattgggaaccgggcgacaagaaatgactttttgagtgaagcgcttgggacatcaacaatttcctgcagatacttcttttcacgtaccaaatttttttccgggtcagcttatcgataagcactacaggctctgatgtggagaaccactaggcgggcggtgagattatactgccgcctaagcacctacgtaagatgcgctcgagctgtgtcttggtgggatggttcgtccgcaggcttcccaatgcctgatcacgattatccacgatgattcaccgaccgcagagctatgccccgacgccgcatagctatgtgccggcgtcgaacctctcggcgaccatcaaccttgatgaagtgagcagccatctccaacggatacatatctgcgcccgtgttcatctctggccatgcgacccactaaccccacgtcgtaggaggtgaagctcaccaacacccgcgccgagcgtgacctgcaggactcgctcgccgaactcttcagcatcatcgtgaccctcgacgagctcgagaaggccttcttgaaagacgccgtccccgaagcagaatatacagagatatgcgagcggtctctaagacagtataaggcgctgttggccgacgatacgatcgcgaacgagttccagggcctggaggagttcaaggcccgatgggatgtacgtatacgtcaaatcatgttcatatcgatccccgacctgattctaatctatcatgtagctcgaagtgccccgcgcgaccgagcgcatacgtgtcggcatgccctctactaccgtgacagcgtcctcctcctcagtcgcaccagccccctcgaatgccccctcgaacaatgcgaacggcctccttatcctcgaggcgacccaggacttcatcaccttcctcgatgccgtgaagttaggcctcctttccaaggaccaactacaccctcttctatcagacgttatccagtccgtgaaccgagtgacggacaaggatttcgaaaaccgaggcaagattgtacaatggctcatcacactcaaccagatgaaggccaccgaggagttaagcgagcagcaggctagagagttggagatggagattcaccaggcataccaaggcttcaggcggacactggaaacataattagaattcgtcgagataaagacatgatatcccacttacataccatgaactgctgataggcatgtgaatgttgaatttgatatgagatttcccagctttttttttatcttcctgcaccagcccatgtatcgctctattaaatcaagaatgtccagaagctcggatacacgagctcctcctcgaatatcctcctcacctgatccagcacgaacctctccaccttgcccacgttcttgaggctctgcttccccgcgaccctgtcgccaatctcgctctccaccttgatctcctgcagcaggcccccgaacctgcccttgggctcctcctccccgcccttctccttcttggactcctcgtcctcctcgtcgggccccacggccgtcatggcgtcttccgggctcaagaagcagaagtgcacccgcttccgaatgttcgccagcacaccgacgccgtcaaacgacaggcccgtgatgttcagcttcagggggatgcccacgaagctcggcatggggtagtcgaggaggatctccgccgtcaggttgagcctcacgtccccagcgtactgtatcctgaagacggcctggacgtcctccaggcgcgcctcgcggtgccgggaggcgcccgggtcgctccggtcctcctcgatggccgagccctggaggtaggtgtcccgcgtgggcgggcgcgacgtgctccccgacgtggcggccagggtcgacacgctcgacttctccctcagggggtgggtcggggaagtcatgggaggggcgaggaggtcgacggatatgctgctcccgtgggacgggttccggctgtggctgggcgggcggaggtccgggtgctgctcgatgggcgagttcatccagctgctgtggcccaggtgggcgcctgcgacggcagccagcggagtgtggctgccggtgtgaagatggctctggaagtagttgagcgccggacctcccagtattccgggcgtcgaggtccctaggaatgggcttcccagatcatgaccgaggtagaatgtgtgctcgtgcctcagagcggtaggtcgtcctcgttcgccagcacgtacactaggaactgcgatatcctcctcgtcatcctcctcctcctcctcctcgctgctttcctcatcatcatctaggtccccttcgtagaagtcagggagagggttggtgatatccttgagcaccaggctaggcgggatggaaccaaagtcgaacccttggaccgttacagacttgatgaaccgcggcaggggcactgtctggaatctgtcgtggatgaagcatttgatgcgctctgccaaagcagcgccatcagggccgcttgtcaacgtctcccaattcaggtcgatggacattggccagggagatattctagcccgataggtgactgaggctccctgtctaggatagaattagattgaagaggaaatattggcaatgattcacgagcagagttgatatcactgattgagatgagatggttagtctccaggctttcggcgggtgtccgagttagtggtgttgatgccccacaagctcaaactctcaccaaatcgcctactctccagaacagggaggacattattatcatgttcatatcatatgtagcatttacatgtgagaagcagtactgcttttcagttcaacaagatcgggtgtttagccaaagcttgcttttatggcttcaatcaatatattcgtttactatatagggcatgtctctttccatggtatcatctcatcattaatagacaattgcttgtccgtattcccaaacattactttactctccgtcctcgtgtttctgaccagatacttcgaatcttgctcgcgactgagatgcaggcgcttgggggccgctgaacagatgccaacaagtcggtgattgtaagatgtatctgcttgttgatcagtactcatgttcaaaatgtgcatcattcatcccaatgtagcgataggaaacataccttgccatggcctctctaaatcgagacttgtattctttaggactggtgacggtcggccgattgcgtcctcctccagcgaacccacgatccttaatccaactctcaagcttcttgtcccacgtgtatgttctaatgcaatcgataataccaacaaccagctcctttcgggtctcatcgacagcaatcatcaatgaatagtccataacattttgtctcgccaggaataacgtgtcgttccacactgaggctcgaagcagctttttggagtgctcgcgggcaaacagtggtgactcggatatgaaatcaaccatgttttcatccaggagcacctcattttgttggcctgtggattgaattctccggttccgcatggaacccttcaaatcaaatatgcgatcaggggaacggtcgtagaagagattttccgtaatgagcagatcaaatttgatgtcagtcgcggtcaaggggttcttgataaagacttgaaagaaacccagcattttggcgatgactgatgggagatcgtggaacagagcctcagccatgatcgagaagtatccaggggcaaagcgcaagaacgctgacgtttccaccggagatagagacttgggtaagttagcaaatgaacaagcaaattcttatataggggcaatggtacataccttgagaacgagtcgatcatctagggtctttaagaagaccgactttgttttaccacccttcgaatcccatttcaaacatcgagataatgattcgatgattcgctcagagacaccacactttctgcgcaaagcgtcaaactgctcagcatagaatattttgcatgtcattacagccgggccttctttgaattgatatttcaaatgtgtccccgttggctgcagcaggctattttccatctccctctctaattcgaactgtgcattttcatattctgagcgagccgggtccacgtccgcctcgtctcgatgcgttgcctgtgattctgctcggattcgagcaagcttgtcttgataatcatcactgttgagaaccagagcgataaccgaacttggctcatcttcccgcacaatgatgtcagaatcaacaaagatgtgatctgttggattgatgggatactcaagggctggccacccactagctgaccgttctgcccaaaagttggtcaagtatttcatcaaacttgtcttttggtgttttggaagctcgagaggaatctcagtactgggctctagagcatccgcaatctctttgatttcggggagaaactcttcagaaaccgtgggctcaacatcgctcgaagctccttcgtcttcggacatcgcctgactactctggaccgttccggggtcctccgtatcttctctcgaattggtttccgtcagtggcggttcgacatcttcaaggcttacgctagacttttcgtttttgagctcctcctcctcctcccctactttaggggcatgttcggtagaaggcggttcgtctccgcggagcgcatcgggggctggagatggttcctcaaatgcatctttaacatcatcatatacctcaacaaaaggtttagtggatgctctaggaagcatagctctgggctggcgcaagcttgcggctcgtttcttacgatcccggacccgctccttttcgaactcgcgactcagctgctcaaaatgacgtgcaagggctgaaactttggattccctcttttttgttacaagccgggggatgttagattggccccctttagtccgatttttcaaggcactaaggccaagtctctcagagagcttcttatctactctgacgggggtctcttggcctgactggtggtcgccactcttatgatccgtaggtatggtcttcgattccttagtcggttgaggcttacttgcggaagattgcgttctagacaatgttcgcacaggatgggacgtagctcgaaccaaaggaggagaagcatgagagccggaccgacgtgctgatgctcggtctggagtatgatgggagctttctgtagatataggcgtccctgctggttcgcttgattgattggactgcgaggcatgttctcggcgcatttggtcgaccttttcggttagcgattgcccagacgtagatgtctggggaggtattttgcgtggaatacttggcgaaagtggccgtcgtggggagggttttggcgaagaaacaatctctttgcgacttgtatcgatatctggaggacgtgacaattcagccggagtcttaatcgaggctgttggagagcttgccaagtccagaggttcgactctctcaatcgcgccttcggtacgagcatcgactttgctctcttcctcggctgatatgctgtcttcaagtttggttgaggatgctacactgtcctctagactaggtgtggttgtatactccgtgggttgggtgctcttctcttcagtctcggagaaagtttgtgatggtcgctcttcactatctgccgcggagccagagccttcagtagagacaagtgactccttggagtcgttgtctgcgatcagctttttgagttgcatcatgatctgttgacgcatatctttatcgccgaggaaatctgcttcaaacttggcaaaggctgtgtcccatgcttcggccttatcgagcatctctcgaacgatagcgttgaacgggacaacttcgtaatacttggtgtttacataaatctcctggagccgttgaaccattgccggttgatcttcctgagccagtttgttgagcctctcaagctcagccttgaattcttcagctttctccggcaggacgctgtctgatcgtatactcttcagccttgctttgacagagttcatgaatttggaccatctattctccattctcttgtatatctcgttcttcaacttgatgtcgttggccactttccaagtaatcctcaaccttgggaccacaatttccaaaaggtcgatgggatcccagtcaattcggacacgggaatcatcaaggctgaagtaacggacatgatcacgatggtgatcatggccacaatgaacactgtctttcatgcgcaggcccctcccccagaaaagtagctctagatatttgccgaaagaatacttgaaggttagttcagacattggtatctcctctgaatccttcttgcatactctgcagtatgtccacatagttatgccgtcgccgagttccggctgtctttccggaatggacgagagttgttcgatggataccgtaattcgtgctcggtcatgcacatatgatcgatggtgctcaatcatcctgcgctcgcatccattggaggaacacaagtcgtttttcccatacaccatttcctcaatgtactggcctaatgtgcagtctgggtcaatggcaggatcgatatagtcatcatcgtaaaagttgatggccaataagactggctcagtgcaaggaattttagtctccgtacaggtcatcgagtacagaacaactatgttctggtgagagtatgggtcaaatagatccagatttccttgaatatatgtttcccactggcgtgtctgggtctggtaattaaagagggctttatcgtattcggcatcatggacagcccggaggatttctctcatctgacgtggtgccttttggccgatttgttccaccatctcaggttttattagctgaaattcctgattattggtatcttcttctgattcaaaggcatcgtgctcgagaagttgcctgagatatgatagccgtctttcttgctcccgagccttcatcagaagataaggctgtgcaaacttaacgaaaggcgatgcggagagtatcttcgtttcgtatttcgcgaccatgtcactgtagaaagtgggcattggtatgtagtctggaacctgattgttttggtcatcatcagaatgtggttcagctgcccctggtagttgttcagcgggctgtgaagctggcgcatcagccttggatgataaagcatcctcaacctcttcagattgctgagaggtctctgtcggagtatcggcaggaggcataggagcctcctgggcagctgggccgggagcagtagctgaactgatggtgggttgatctgaggtggtcaaagaattcgtagatttcaaactctcgctcaaagcttggatggaatttgagagtgagttgctcgcagattcaggggggtcgatggattcgtctctgagcaaactggattccagctttaagttgtataccacgtaaaccatgaattcaacaatgtgtttaacccgtgccaaaactgattgtttcgccccacgaatcacaatagtgcagcccagctcaggcttgcaccctgaaaggtagatgtaagacttctttcgccctggatgatcgttgttgacaaacgttcgaacctcgaagcccatacatcgccccaccttgacaggcaacgccagcatgtcaagggatgagatgatttctgtctcagcgcagcgtgatacagcttcaatgacggtgtgcttgacattataggcaaccgcaatattggcttctgagagatattggagggcgacgcccgaaacactcttctcagctaagagtaaatgcgggtgtagtttgctgattctttgtacaactaccctgagaaattccttttcttgctcaatgactggctgcagactcataaagtgctgctggtgtcgttggtattcgagagggaacgtgacgagaacgattcgagggttgcttattttgcgaggcatacttttgagagccaagttctttgtaaagaccacaccagacacatatgcggtatcgccaggtttacctcctggtattcttttcaacttcacgtaacgcctgatgtccatataatctctgttcgcaacatccgggctcacatcatcagttgactgaagcaaaattggaacaagggctcggtcccacgccgctggttcgggaacatcggcatctactaacagctgccgcagtagcttgtggatatgctggatgctggacttgttcagctcggccttaggcggtgcacttcctttcatcaaatcactgcttgtgagaggcggtctgccttggctatgatgctccaacgcaaacagcaactcggatgaggcagatgggcccttgaaagctgcagatttgtgtctcggtgatggcgcgtagtggtgaacatttccactttggcttagattccgccttcgcgttgatcgacgatgactgatcatacttgttggtccactggcatcatcaaacaagcctttgctaacaaagctcacgccactgacgctcttctcgcctcccctatgacgatgtttctttcccaggttgatagaggagcccagagtagccttgtcattgtcgtagctcgtcgaaggaagatccgaagtggacatggtggcaaagaggctcatctgctcatccccactggattcgtcagacatgtaatcagcaagctctgggtcaatgatgttgtcatcatggaacgcagggaacttgggctttttctttgcttcatcatcaacccctttgcggaatggcgctcgatcatctggctcagatttgaagcgattcagaaatccagccttagaatgatgtcttttgtgcccatgcccggctgaggactgaggcctacccgccagggacttcaatgaccgagaggaaccgggtcggctcaaagtaggtgagtctacgtcaaacacgccagatgaacggttagcgtcacgaactcgtcgggtagcaggcattcctatcataggagcagttgggacagaacgagaatcttctgacccttccgacccgccggtggcatcttgttcccttgccttggttctatctgcaccgcttggcgatttggaatggtttccaccaaagaaccgtggcataaatgaatgctcatctccggattcttcggaagcgctaccgtcaagccgtcgactgatcacctcaaggcatcttttacagacacgaagtgagccgtttacaccaaatctgtcaccagatatgactgtggtgcattttgcatcaaaaatgcagccacaggttcgacagtgatgcttccgcctaaaggcagtaaatggagtctggcaaagaaagcattccttgacagtatcatccttcatccaaaattctttactgagcacttgtcttcgcattctatctaactgcgcaatctgatcggttgcgccctcgtggctcatggtcgttccagggatgcgcaaactaccagaccgcatatgttgagagtgagattcacgagagaacccatgatacacagaactatgggcggaagtgatgactggactggcaactgctgtccctctgtctgtagaagaatctctggagccgtcacgtgagtgagagcggcctagccgctccagggctgatggtcgtttatgaataccatccggaggtagcatggatgatccgccagacggggttcggatgtgccgtgtcctgatggagggaatagagggattagaggcagccgatgccgcgtttgctccatcgatgctagcaatactagacgcgtcatctctatgtgctcttgggggtagcttcgactctgcagaatcatagtagtccgacgacggctgtgttccaaggtgtcgttctagatcgactctacttaggctccgctgggaagaaccatcggcaccaacctgtcccaacacatttcggcccgtgtcctccttggttaaaacaggcggatccgcgatgatggagctggtcgcattcgttggcaagctctgacgactggaagattgtgattttgtgccagacatcaagccgaggcctgtgactttggacgatgactgcgaatgtgtacgggtgtcgggatgaattgggctaatagtagaggactgcttgtcactcgcactggtttggtgtgaagaaccattcgtagatatcgtcaacccggtttcggcacgactgagagacgatatggaatgcctcgaattacgggcgtcggcactgttctttttggaaagagtatccctgatctcggcatcctcctcttcgtggtttcgtttcgtagagctgccgacaccaactgcttctcgaagccggctatacagtccactgaagccctgctgtactatgtcacctgtggaccctctattctcgacagcgatggtggacacgggcggaggggcgaagtcgttgaacgtggtcaaggagtcgactttactagcggatgtgtgtatcttgtctaaggcggaagcaagctgctctctctcgataatagaactggcggccatggaagcgacagagctacgtcgatttcggaggctaactggcgagccctgggagcccgaggcttgggagatcgacgggtttttcatcgcagagacgctgtccataatggcggcaagtaaaagcagtgcggtgcctcagaataaaactgccgttcggtgggcagtagccgtgagcggctcgtagattgttcgtctaagtggtggacgagttcagtgggtcttggggcgaatacatagcggacgacagtatcttcagcgcatattattcccgttgttcggtgggatgaaggttagcagacgagaggcatgacggataaggaagatggaggctgtcgtcagaggttggtgagtggcactggagcccgataaaatggctggtatggaaaccccatatgcaatcactagcagatagcggtgcgcaacgatgaatgacgctgggtctgagcctaggtaagccgctggctgccgataaggcaacaaagccccgtgaacgtagagaaggtagaaaatgcaaggcaagataggtaggagacacgggaccttgcgcttactggatatgcggaatcggccaaccaacttcgagttcaaaagtaggaaagaggcgatgacgacgagggaccaaacaattaggtagatgcggaagcttagcttgatcatcatagtggagcttgggcatgacagatggctggccaaggtcggtcagtggtgagtacaaggtacatgtcggcacttgcttattggctgcatattctcgtacacggtactcggactggttgggctctcgccattggtgggccctaccaggtgcaccctgtccagctctaccaggacgtgtatcttccacagctcagacgcgttgaaagagttagtatctgcaaatccggcaacgtcccgcggccagttgacaattctggctgtcgcaatcgaccatactatctctgcatgtattgacatgccctcggatgaccaggccacgtacttttaccagatgcaatgatcaccccacgcttatgaaaggttggtggcagcgtaggttagaagatcctcggagatggctcatgtcgcttctcagcgaaacatcgccaatctgctgaaacgcagaaatgcgaccacaatccccagggaccagcaaaagatcctagatcaacccagctcttgggcggtggagctcgatggtgattcccaactccgagtccccaggcaagtcttggaaacggcaaaagaggtagccagagcctcgcggaaacaggccaacacagagaagaaggagccaacattgcctcaaggtcgtcaaccagagaggatcctgtcagagaccaatgatgtggcaaaaagcgtcccagattcttcactggactcgtctattggcaacgctacgcaagagagattcgtatcctggtctccatccccagcacgatcactggcaggcgatcagcatcattccccgtttccatcttcaattaaagacggcaactcttgtcgcgaaagctcaccttcaatttcacggaggcggggatcaaatttctctactcctcccccgcccgcttcccaagtcgcattctctgatgggcagtcgtcaccgccaccgactgagcatgacagggcaaactttcttaagcttcgtctcaccgagatatgggggggcaatgactggctgcctccttctcatcgcgaccggtcacgtctcacgttgagcgagagggtattagcggcactctttcgagtcactgaaattgcccaactgaaaggcgttccgcttcagtcgctctggcaaaagggaggccatctccatccgctttctaaaagctggcccgatgtggaagaacaatgtctccaaatggtacgcaggatggagacgaaatatgccctcgccgacagagagatagctcatgcgaattctcaagtccttgccgataatgacgacggcgaagaaactgtagccctgcaaaaaaccaagccggctattatttcgcgatatctcgcagcggacttcaattttccgtcaagcgggccagaggatgcccttgaaacggaactaccagaagctcaaatagtatcacaagcccccatcaatcgggccgccactactccccaactgtcgaacaaatcctcgtcgagcgcccatattcctgctaccttaaacacaccgccatgcgcgcagccgagccagcgcataataccagctactgttcggaaacacccaagcccgccccgagaaggcctcggcgaaccaggaaagaaacgccggcgtatgaagccaatccaattcagtgatcctgatgacccagaggagaatggtgcagcggtagaaagtagcaggaacacgaccaccttctcacgcatggcgccaaccaaaatctacacccagatctcgagttctaattctattccttcgagcatagttgtgccagctaccatcccacaatctccaacaattcggaagagtccgccccaaggacgtgctcagcgggcatctggactcagcggagcacagaaccaaactgcaggtcagctaaatgataagaatgatgcgatagagataatagttcccccaactatccctgagctcaaacctttcgagctcttcacacagacatatcccgcttatgaaaaggattaccgaggcacccgatggtcatttataagagcctgcgtctgcctggactatttaatgaaagccaactcgttacgagagtatctgtgggatgactttatcagagccttctctgcagattatgtcgaatacgttgaaaatactaacgatccccttccagccctggattggttcaatactctcactggcgcaccagtgttcactcaactcttggtcaaaagggacaccatccatgatatactgaacacataccctgatgaacttcagatggcaaaatcatacaccaacgaagaggggaagatcaggggcagagatagccggtcccgtggaagtgaccataaaagtgcaagtccagctgagccacctcgggttagccctcagcaaatctcctcccctccccgcatcctaatcgattccgagactgtagtcgaaaccgttccctctacatcaatcgaggtgcaggatgtacaaaataacatttcgccaatctctcccaaacctcggctcccgagttcaccgacaacgcccaaggtagatcaggagcctgagaaacatgatacgcccccgtctgaagccacagtgcctagcacaaccagattggagtatcctacacaggttaactttccccatccgctgctggacaccccgcatccacccattccatcaagcgcaaggtcaactgccacgagatcgtcgacaggcactcgtcgagggtcaagttacctccagagtctcgcgtcaagcgccaaggatccggataccaagaggcgggaacgtcttcgacggcattttcttaagaagaaatccggctcgacacccagctccaggaaggctgcctgaagatagtaccccctggtgggtttggcggtcacagtcacacacagcagctacatgtcacctacttgtattaattagccaaccgtgaaggagaactacataaacaataacgacacatatgagcggatgcgaatcattattatgactggcgttttcaattatctgtatatattcccccaagcagagtttagtcattcaaaatgggcaggcgcatgagatcatttcaattgtatccggggcagaggaaaaggagaagggactgatcaaagtataaaaaaaaaagaagttcaacattcatttgtgcgtgggcaacctgttgttctaaggtagagcaagaccagctttccaagttatttccataggctcagccgtggctccccgaggagcgttcaatataagttttctaatccgcaaaaattcaggcctttttccgggattctctgtgtctccgggtgcagtagaatacatcgaggccaggtgggctcctgttgcgtagcgttctctcatcgatccttgacattctcattgctcgtttccctttccgtaatataataagataaaaaaaaaagaaggaaaagaaatgtgtggtgaagaaaaaaaaatagagagaagaaaaaaaaaactccagaattcatgaaggcatcaattgggaacccaaagagtgagaggtgggacaaaaatcaatcaataagggtcgccttgggtgtgggtgtgtgggtgtgggtgaggaatattaggcgggcgacctactctgcgggtgcagggtcggcttcggcggcggctttggcagcctcctcctccttcttcttcttctgacgctcctcctcctcgggggtcagggtcctgagctggagggcgtggataccaccctcgagtgccatctcatctcgcaagagggcgtagaccatgcgatgcctagcgggctgcatcttggaggcgaaggcatccgaagtgatgaccagcctatgcacggatttagtgaccagtcagacgggtgggtggggcgggtaatgggcatgcgatgcgagcagagcaataaggcagaccagcatgtagggagggaggcacaaagagatgggtgggtgggtaagaggccgacatggcctgggatagtggtacctacctgaagtgcgtctccttggacgtgctgccttgcatagccttgtggtgggcatgcagatgggagtcgttgtagatctccagagtttgggggttgaacgccgccgtgatctgctcggtgctcgttagatgattgcaattgggaaactcgaggggattggggggttttaatgggctgaccttggcgcgaatggcatcttcaaggggagtggttgaactcatgttggagaactgtcgtcccacagccgaaaatcccagagcgtaacgtcgaagcatggtgggatgtcgaaactttttttttttttggctgtgtcctcttacagtcgtcggcagctgcacataaaccagatgcacatacacgactgttgcgaggatatagcaaagggcgttcacgtcctgtcaattggattggatgcgtgggtgggtgtctggggaaaatttgaatcgaggttacacggcagcagcaaacaagacgaggtcaaagggacagtcaatggcggacggcgagcgggttttaacaatctagccagtcaattatggaaaggaaaaaaagaaaagaaggcccaagagacgggataaaagaggtggtgaggagggcgggagtctggaggcaaagtaaggaaaaaatagtctggcgcggaccagaccagacactgacgtccaggcctacctccgttaggtattttcggtgaggtcggagagacgaatcagacggggtgacttggtgagcagcaacgccagacggacggcggctgtccaatgcgatgagactgagttgcatgacagatgcatggcggtgacgagacgcaagagtcagtgggtcctttgggcttaggggcctcgccgcctttactcggcgcctgcacgcgtgccagcaaagcccgccatcccaaccacgctgccgaccgacaagtccatccctgccggcatctgcctcccatcctcatggccggtgcggtgcggtgggtgcatgcggatggtgccgcgtgcgtttgcgttcgacggccccctcctctcctgcagtgagcgcgaggtcagggagacgggtcggcgttgagggtgcgtgggcagccagtcacccgatgtctcagaacattggatcaactaggtggtagacatgccgtctaacgttgtccccgattggcaatagtgccatcgtacggcagcttccattgattgacaccatcatgcgggttcacgagagatctatcgccgtgcttgcatgatgccgtattgggagccatcttggaggtttgcacttcgggagtgttggcatggctctgcgcctatctctaaagatatcatggggaaaactgagaaaaacaacgcccgaaagaaatattcacactacctacctatgctatggccttgtcttcatccgacacccgcaagtcctcggtagccccagacatccaaccttctgtaacctgcaacccaacatcaaacatagtgtcataacttggcatggccagacatcaatgtctaagccagagatgcgtctggccaatgggatcaaccaagtgatcatgtccatctataacatgactcctgccatatcagtgtattcaggctccaacaaggcccataacacacggaacagcaacaaaaacaataatatggagagtcttgtccgccacaaagaacaacgccaggatgaatccctgctggctcaaatgacgaccaaacgtgaccacgtcggtggacagcaaatcgtgcaggtgtgataaaaaaaaaacaaacgggtcggcgaagatcctcgaatggcaatcaggcaaggcgggaagcaaggaactcgcaatcacggctcccatccagtcctcgcagatgtttgggcttcccttcctgtacaagccgtcgtctggagagcggtgtaaaagcagcgctgcccaggcacacggggctggacttgaacaatcccgccttttaggttcagggagtacaagaggaaatcccgacagttgccacgaggccaaggattactctcgttggtcagtccctggccgataccgcctttttcgccctcgtacctggggttcgtctaccaggtacatgtgcatcctgcatgcatagtctgcctacgcggaccaggaggtaccttattgtacatagtcccatgtaaaatatgcacttgggagatgcggatcctgtctggcgggagcggctgggagctatccttaggcagctctactcgagcctagaggcccttagcccttccatagtcctgtgacagtcacatcagctttctttttcttcgctcacctttctttttttgtgggacgggcgagggcggggtcgtttgctttggcgttggaggaacagcaaatccaatctggcggtggagagcccaacgcacgccgtcagcaagccgtcccaactcctcttgttttgatcatgacttctcttctcatctcatctcatgtgctgctgcaccgtctcagcgcattcaatacgacgtccagtggcaagacaggaggatcacaacactcaggtggacaggtcaggctggccggatgcatcggtcgtggagcagtgatatgagcatcctgtcatcaggaatgatgacagacggcgctgaggtcccaataacaaggcatatcgagtaagacgcatccgcttataatattatggctggctactgctgcaactatccacacgcggcttatggtggtgctgagcgttggtgcctcactgtgctgtcgcaatgaagtctcactgcatcgtattcgaggtgcacacgtgatcactgtgtcatcaatgcagacgtgcctcgcagattgctcgcatctgggacggctggtttgatcgtcgaggcatgaccgtggttttgttttcctttgcatgttccctctggttgccttgcatgctcaacccgatgtgatgatgactgcatgtcgacgaaagcttactgagtgacacccttatgccttggtgccgggtagctggcaagttattggcgacggcttgagtgaagtgagatcaacggtttcattgttccctcatgctccctcttttccctcatcctccttttgatctccctggaccttggccgcctgctccccaagaacccccatctcatatagatggcctcgcaacctagaagaaggcgccgaaacgatgaaatcacccgctagagccaccttagacggggcctcgcccagatcagcccccactctgccggctatctctcggccacggctctctcccagcgcctcaaacaaacaatccgcaaccaaaagcgccgccgatgctgctgcatcaccagtgtaacaacagccccaacaacccaccccctgcctagagccatttaattgccttctgtattaagatccttcagttcgctttatcgtccatcagttccacaattcccatgcccgctgccgctctctaatcctgccctacctgtaccaaaaatccttgtctcccttcctcatgtacctatcaccatccaccattcgccgcctggcgtcatcccttccccctcgcctctcaccatacctcctctgccgccggacaatggctactaccctgccacgcctgccggtccttgaagccgttgcggcccacgacccggcgtccaccgccgtggtccacagcctatcaggccgctccttcacctatggtgagctcctcggcgacgttggccgcgcaagggaccgcattagacacgctcggggcggtgccgacctggacggcgagagagtggcttttctagtagagaatagctatgactacgtaggtgagcaagctctgggaaccagatatagactcatatccgtaagaaaagcttagagtgtcattttcgctaataccgtgtgccgctgtgccattgggttgatcagtgacattgttggccatcatggctgcacgatcaatcgccgtacctctgtcccctgcattcccagtcccagaactgcagtatatcctaaaccagagtgaagcgtccgtcctcgtctcctccgccaagtttggtgccaaggcaaagcaggtcctggaatcagacctaaaagccagtccctcccatctagagttgtcaaagcatctcggtggccaagggaagaaagaggatatatcatgggacgacgcaggccctgggaatgccggcatgatgctctatacttctgggactacaaaccggccggtacgtcatcctccaactacacacaactcacgtcagatatgctaacatccagcagaaaggagttctcctcccacaatcagtcctcgcagctcagagcaaatccctgatcgaagcatgggagtattcccccaaagaccggctgctccacgtcctccccctccaccacatccacggcaccgttaacgccatcctcacccccctcctcgccggctcctccatcgagttcatgttccccttcaacgccgacgccgtctggtcccgcctcgccgcccccttcctccccaccaacggcacctccccggcacaggccaaggccaagatcaccttcttcaccgtcgttccaaccgtctacagccgcctcctcgccacccacaagctcctcccaccggagatgcagacggccgcccgcaccgccgtctccccagagcacatgcgcctcagcatctccggctccgccgccctccccacgcccatcaaggcgtcctggcgctccctcagccacggcagcgtcctcctcgagcgctacggcatgacagaggtcggcatggcactcagctgcggcctccacccctccgaccgcgtcgacgccagcgtcggctggcctctcccctccgtccaggcccgcctcgtcgacgtcgacaccggcgacgtcatccagccgggagagggcgacgtcgaccccgtcaccggccgcgagcgctccggggagatccagctgcgcgggcccaccatcttcaaggagtactggcggaaccctaccgccacggccgccgagttcgtctccgacccggacggcaagggctcgtggttcaagaccggcgatgtcgccgtgcgtcgccccgtcgagtcggccgcctttgcccagccctgggccaagggccccctgtacttcatcctcggtcgcaagtcggcggacatcatcaagacgggaggcgagaaggtgagcgcgctcgaagtcgagcgagaattgctctccctgcctgaagtctccgaggccgccgtcgttgcggtgccaagtggaaattggggtcaaaaggtcggggctgtcctgattctcaactcagaggttgcaacgacctggagtcccatggacatgcgccgtgctctcaaggggcggctggccaactataagattccccaagtcatgaaacttgtggaccacatacctcgcaatgccatggggaaaatcaacaaaaagcaactcgtcaaatccatcttcaaggatgagcacagtgacgatgaaatgtagttcaacatgccatttactccttgatagcacactgtacgatacgttcagcaaaataaaaatataataactcggcatgcatctaacgaactaatatcattggatgaagacatctcggaacaaaaggacagggggggattccattattacgaaccaatactgaatactggccgcatccgcctgaacgctcatccacttgagaaacaatgtttcctactaacgccggtcttaaaccttggtgtttcgtaagctgtggtagccagcattctaagcttacatcaaacccatctcatgatattgaatgattttcctccccgtaacctgatcgccatgctggttccaaggtattcccacccatgcgccgggacactgtggcaggggcagtccaaaaaagacctggctctaggttaaataaaaaagttctcctcatcttgctgtggccacatagcggcctttacacaacatgcttggccttggccctcgtgcttccagcatttgcgctgtctgtgtggcctgagaactcgacctgctcattagcgggaagttcgagaacctccttgaaccggcgaccgatgttcagcaggatgttcttgcccttctcgttggtacgacccttgccgccggccacatcaccatcacctcggcctggaatgctctttcctatcgtgcgagtccagacaccgattcgatagaaggccttgcgaacgttgacgaccacgcccatcacttcaccgtcgtcttcgtcctcaagtgtctcaccaatagcagacatcatgacctgaagccagagtcggtcaacatcgacatttcgcttctccttgtactggtaggaccactttccaccgtgcttgttctgagggtcctcccactcgggtcggacgccagccttgaaaagatggtaatcggatttcagagccagctcggatactgcggcgacattattctaatattttgtcagtaaattaaatttgtcaaattctgtaggggacaacgcacatagacaccccagaactcctccactgaatcaaatgtgatgacttccttcagaaggtcattccagttgtctccctactcacaaatgaggtcagcatgattcacagaggttagaacgggggcatctcaccttgccactagggggcttggtgaaccaaagggtccatttgttctgaaggggatgcttgacgttgaagttgtccttgtcgtggaagacggtaactggcttgccatcgtcgacggcgtctgcctcctcctttccattgggcgaaatggggatggttgacaggtcaacctgcttgttcatgtcggtttcagacatcgttgcagtcggataggcgcgcaaggcagtggaccgagtttgcaagcagagaacttgggcggaacaggaatcgatgtggggagcggtcgacccaaggaagtattgcgatctgttaaagtggtgaggaaaatagatccactattttcgcaagaagaagcaggcactaggtacgtaggtaaggtaagtagaacttgcgccaggcaaatctatctaccaaggaggaggtggaatgggtgagagccgacagcgaattgtgttgggtagtggcgagcgaggtgtgcaggaagggacttgggccagggttgatgctgactgttggagtgcagaaaaattatcggcgccgcctgcccgctgtgccttatgccactacaagcgactgtcgcgcgcccacacaattttctaaagttggttgactttgtccacgcgctagtatctttttttttggcagcatcattcccccaccttccacaaaaggactcaaccttggcttgaattcatgctagtgcgaattaagcctcatatttcaggcatcaagaatctcctcactccaaagtgagggaaggaagaaccaagctcacttgataatgacatcttggcaactggccgtctttttcaattttcaatttttttattaattgttgtaaatctaactgattgtcaagagtattaatcctattatttttattgggaggctattgttcctagcaaaggggaagcaaaaagccgccgccatgtgtatcggagaggatcatcgagttggagatgaatggtgaaaagaaagagaagcacagacttagatttcgattgtttttagatgggagtaaccttgaatgcatttatctagaagtaccggacaatctgacaatcacctcggggggagaggacgatacttgctgttggttggactagtttcatgtagtaccaagcagattggcgatttacaagatccatacaacctaagaaccagaaattgggatctcatcgggaactttcagctcgtgttgcggctgggcaaatctgtcacaacggcctggtgctgtcggcgaccagttacacaacagaaggcttccggttcaagctaaacagtctcatcataatctagaccaaaccttgctatagaaatattgtgtctcatgccccttaattacattacgcaagctaccttacatgcaagaataataagagcactggcccactcctggggaaagggacatgtgtttcgggcgctaggctgaatattctgaagcaatggacggcaagccacttatacgctccctgatcgtcaagtcgatcaagatagaaggtactccgtactggtaggtacactggaacctaacgacctaggtttgacttcccttcattctaaggatagcatcgaggtacggcccacaggcagaagagggatcacctggcgcattttacagccccatctccgtgagcctgaataagtccgaggctgggaacgcaatatcgggcatcgccagggccaagtgaaacctggatcaggaacagctgcgggaaggcgacagacggaacgctaggtaacggctgatccattttttaacgacccggaagcgctcctgggcctccgcttaaccctgcaaggaaccttccgcaagtacaacgctggaatttccaggtactttgtgcctaaactgtcggtgtacctgggagaagcagtagcagcttgttgcgcttgccgacgggaatcaggcaaatgattctgcacatcagcgaattcaagacatcccaaggacatctgaaccttctgaactgccccaggccacttcacagggactcggacggaagcaagcagctgtactcacagctacccctggggaaacggcttgtgggtaccctcaaacaccagcctcccgcatttcgtccatggccacgacctagcggggactaactggttggtaccttacctatctagatgccttggccactaggaggagcaattgttggcggctcccatcgtcaatgggtcatggatgtgatgtggtctgggttgatgaattccctgaacctgtgggacttgtgaccgctactcccagccaccatcgactgcatcgtcatcacagggatcatcgaggagagccagggtccggcccagttcctgacgatactcagcgtgatgtcaggcatctcccacttggctttcatctcgcccgaacccagctattccatttcctgccgctgtatcatagttttgaagcaattcccagcctccggccaactgctttggccgttgcgctcaagccgaaaaccctgcgtcagactgcaaatcagacctacagcagcagccaagtctttttcatcattctcgggcgtaccaccgcactatctgcacaccacgagcacctccctagttagaatggccgtctccatccgaccctaaagaccgcatcaggccaacaggcttaattaccatcgccccgaacctccaagaagatctctgcatggtgcgtatgtacccatcacctgcgtatgaatccataaattacctccgtgccatctaccggccctgcaacgcacataccggcccattagcctacgcctgtctgcgttagctgcctcgtgctgggggaggctggagtccaaccgtcctcaacgcccaggccagacaccccgaacggtttctttttcccttccttgtagctccaacctccagcctcgcttgcagtaaggctctttcaattagccccatcctgtctctcaacgaccaatcacggctgcattgctgatggccgcaccctactggggccaactgcctgggccgaaaattgtcagagctcagcgcatatcagaagaaagctcgctggatgctccaccaccaacatcacataaccgccgcgcttcggtgcagactgcgctcactgattcacccttcagtccgtccttcgaatctcctgtcccttcttctatagttgctcaaggcctagccccaagacctgcctcatatcaacggccacctgctcccacagaccaaacctcagcgagggctcgacatcgtgctaaaattgcgcgggccgacgactttagcgacgaggaacctatctctcctgatatatcaattgcccccgacacatctcgtggtcctcctttaggctttcggcaaccttacagcgagggcccatcacacatccagacctcctccagaggagacagccgctcgcgggagccagcttctccaattcgagacaagatggattataaggaggaggaatacgaacaggagccaaacgggcacaacttggctgcccaggctgatgacggccaattcccacaagaaagtgctgaaattctgacgagaaaaaatggagggggctcacaacgtcggaaaggagcattgccgaaatcaccactccagagactcgagatgacgctcgacaccatgacaaaagaggaaaagcgagcccgtgtcgaagccgcagagcgtcgagcccgggaaagatacgcattgaaggctggaggggctgcccagccaacttcctcacacagccgcaaacaatcagtgagccgtgatgtcccaaggccagacccagtcgctgtaccgagcgcgtcaactagagaagttcctatatctagagaaccatctgtccggaaggaagcacctcagaatcaaccccaacagcgtcaccaatcgcatggcgaacaccggagtaatggcccaagcataacacagcaatgggggaatgcgcaatcagcacatcatcaagatcccggatccgggcaccctaagcgcaatttgagctttcgtgagcgcgccgctcgcgacgatgtgaatattccccagcatgatgttgaggacgcttatgttgaacgcccctacactcacaaagagagtgctcaagcccaagtgccagcctcgtcatctgtggcgcgaaatgggagcagcagatcgaaagccaaccctcctagagacaatcaacgccgtccacgaggagacgatgatttctcgcaaactgctagccctggaccctccagtcaccaccattctgcggcacagccaagtagaacaagagaccataacaaaagacaatcaatagacacaagggatcgtgaaatctatcagcctgaggcagccggtgactatccacagggacttcagcgcagagctacagagcctggccacggaaagcagcgtgcagagcctgatctcgctgcccggcccgtcactagaagtaacacggtcaggcaggacgtggcaccgcgccaccacggcgagggggctccggcactgcgttcacagcaagaatcctatttgcccgtccctgttgctggctctaccagtcaaacacagattaatagggaaagtatgcatcctggcgaagggctctacaagtcgccggtttggctagacgagtggaaaaaagcaaccgtcggcttacttgcggggtcgatgctgaagttatccagagaccaaatatctcatgatatcccagcttccagcgataggaataaggcctggtgggagaacagcggccaccggaaaacctcgagctattcgggtagacaacggcgggctgaagctttcgagggagagtacgacaataatgattgtaagtcattaacgaacgcttttccccaaacccaactctgacctttacttagctccaactcgattcaaaccaccgctgtatttggagtgcggtccactgctcagatactgtggtatccgccgcgaaaagttgcagccgcgcactggaggtgtaagtggggagagagacatatggcgaggaagcataatgattgttacacggaattcggattcgtcgtacgagatcgccccgacgcttcgattatttgtccaagacatcgagcttcttcctacccctccccacaaggtcaacggcgaactctcacccgagtacgttgacccagtcgccggccaccccaagcttggtcgtcgtggcgaaaccttgtacgtgcggccggtggaccacctggatgagggcatagatctgtctcaggatgaaactgaggatggcttgtttgaatcaacaagaagccctccggatccagaggatcccgcggactcccatggcagcttcgcgagcaggatgaagcgcatcgagcttgacggtgagaaggcgcagaagtacaaggatgttagaggcttccgacttcacaccgagaagggagtgacattctggaggttcaacatagaagttgagcttcaacagaaccagcagcgaattgcatatcgtattaatcgtggaccagccatggctttctgggtgcctgcacaagggaaaacgatgaacatcatgttccacagcggcaacggtttcagcatcgacgctaatacggatgccgtgagcggccccgacccgatgtggcgcgatgtgttgaacagtcaccagagctcaccattccacgtcatgatcggaggaggcaaccaaatatacaacgactccgttgccgaccactgtaatctgttcattcgctggcttgagctgaggagtcccgccgaaaagcggtcagctccattctcggctcatctgcagaagcaggtggaggagttttacctgcaacgatattgccaatggttttcctccggtctttttggccttgcgaattcgcagatccccatggtgaacatgtggtcagatcgcgaaagtttccatggctttgggtcgtatcctgataaggatatgagctcgccagtcctgtcaggcattggagctgtcgctttcaaatactacatgctgttccaacatcaaaccatcatcccagaaacgcaggcttctgagccaagttggatactggggtctgagcctggaccctatgtcaacgagctgtcgcgtagtctctacatgtctttgggctcaaaggtttcacttctcgccgttgattgccgaactgaaaggactgagctcgaggtaatgaacgagaacacctgggaagccatcaatgatcgagtgtacaacgaattcagacgaggccaagttgaacacctgcttgttgtatttgcgattccgttggcatatcctcgcttggattggcttgaaaatatgtaagtcttgcagcccgaatttttcaaatttccacagattggctcggagctaacccacaaaacagtttctcttcccgggcgatggatcccatcaaacgtcttagccgaaggggtctctttggcaaagggctcagcaacattgagaatggcgccgaggtgatggacgacctacgagaccattggacagccaggaatcacaaagaggaaagaaactttgtgattgaggatttccaagatctagccattgataagtcgctccgagtgacaatcctcagcggtgatgtcaatcttgccgcagttggtcaattctgttccaaccccaagcaggggctggccaaacacagggatcccagatatatgccgaacatcatctcgtcggcaattgcgaacacgccaccccctgacattgtggcagatgcactgaataagcgacataaggttcaccattttgacaagcagaccgacgaaagtatgattccgttgttctcaaacggtgttgatgggaagccgaggaataacaagcgtcttctaccccatcgcaactggtgttctatccggaggtgggagcctggcaccacgccaccacagacacccgaacctccctcaattcctgacgaatttccaagcccacagcaagcgcctgaaagcagcgcaggtggtggaggtggtacaggtagtgcaggtggaagtggtggtcttttcagaagattttctcttagcggaccatcgcaccggcctgacatgtccaaggaatctgtccgaggtcccaaaccccccgtttctggagggctattccgcagcctctcgcgccgactgtcacgatcagagcccaagggacccaaggaacccaaattaccgaaagaggaggttcaaccccctccattgacaagaagcatgtctttaggccagggtgaggcgacccaaaagcgaggccttttcagctttttgagacgcggtagccagaagcaaaagaatatggctgtcgccagcagcgataactttgcgcccagggataacttttcgcaaagagacaacttctctcagagagataatttctcccagagggacaacttttcgcagagggataacttctcgcaaagggataacttctcccagcgagacaatttctcccagagagacaacttctcccagagggataacttctcacaaagagacaacttttcgcagcgaggcaactttgcgccggaagatgacgacgatgattactatgagacccaatactatggccgagaacgtccatcaggcattcggggaggcgcagcatacgaagatgagtactcagaaggcgatgatgcgtatttccagtcaagggcccctcaaagggcgcaggcgatgggctcggcccagtttgatgacggctccgttccgccccaagcaatgaagccatttatgcggaccccaactggcctctcgaccaagcagatgaagaaggcagaacagtatgaggtcgacctcgaaggcgggctggatatctgtctcaatgtcgaagtcaatcccaaggatcccaccggcatcactgtgccgtaccgattactggttccaaaactcttctatgagtactcgtccgaaaaggatgacattccggaagagcaacccaatgcattcaagagatttttgagttttaagaagaaggaaaagaagccgggcgagagtcaacagaatgactactacgatgatactgaagaggattctgacgaccaagagagccaagtggatcctaggtcttgattgaaagaaaaatgtaacgggcatgtggcgtctttgttctttctatgagggtgtaggtttttgtagaacgtgggtggaatgttggaaagctgcgtggaatgcatgacttgtatgattgaacgaatggtttttgggaattaaagtaatgatgcaatgaatacatgtagctattttcttggatatcaggccaagctcgaacacaaacaatggcattactgtctatcgctcagtctcttaatcaagtgtcttatccgtctgtgaccctacaaacctcagcatatgtcaataggtgaggctacattatgcgccccagaaaggcccctaatcccagtgggccctccccagcgcagtgcctggaattaacccttattgttctagcctttttgcagtggcgactgggtttgttctgcgggagaattggacctacgtaattcccatgatacaccaatcaggagcatccattgcctcgattcacctccaatttccaaccacgtctgtcgcttgcaaggtatcccttttgctctaatcccccgtcgttcgatgagttcattcacttgataattctctttaattctcccacgcgtttctcttgattttaagtttataggcacaagattgtattatatcctccggctggccgcgacccccctcttccccttactcgccgttcgaccaagcaccgcctccctcatccaaagaaacgaagccgggcgcctgaccgacggggaatggccacggcgaaatgcctcactatgatgcatctgtagccgaccagatcacatactacctgagcgccaagggccagcggttatgggcttgggccaaaggacctggccgacagagggcgacatggctatccctcgccgcgatccaccagctgcgcaggaacctgacctcgaggcggttatggagcttcccgcacttggttgttgttttttgggtcttgattctgctctggggcgagcggtgggtgtttgacagcaaggttgcgagctgcgattgggatcattgggagaactgggtaggtggtgatgcccccttgtctgcgcacgcatcacggtggactatctgcatatggaaggcttctttgactaacgcatctaattctcagccgaagggtgcaaacccacaccacctcgtcttcatcgccgacccccaaatcatcgaccctcacagctatccggggcgcccctgggtgctctcggagctgaccatgatcatcaccgacaactatctccttcgcggatacaagtctctccagaggcgcctcaccccggatacggtgatgctcctcggcgacctcttcgacggcggacgggagtggaagacgcaccgcggcgagttcgtcgacccgcggtgggggaagcagcggtcgcgcgacgaggccaagtgggtggatacatggcaccgaaagtacggcgaggagtactggctgcgggagtacaagagatttgggaacatcttcttcgaccattggggcgatggcggggacgcaccgggggcttggcagcgagggaggaagctgatcgccagcttgcctgggaaccacgatctcgggttcggcgcccaggtccaggtgccagtgcgggatcgcttcagcgcccattttggagatttgaaccgggtggatgttattggaaatcatacattcgtgtcggttgatacactgtcgctcagcgctgcctcatccgactttgctggcacccatgatctgtcgccgatatacggaccggtcaacaggttcctcaagggggtccaggcttctaagcgaagggctgtgaaggcggaactgagtgcctggcacgacggtgctgagagcctcaaatacccacacgatgttgaggaactggaacttagtaccgaccctgaagggtttcccccgaccgaccctggtgccgacgctgtcgagttccctactatccttctcacgcatgttcctctctaccgcgagcccggaacaccgtgcgggccgcagcgcgagcattggccgcccacgaagcccgccaagggcgagactgggccgacgataccagatcacagaaatgcgatttcagtgtccggtggttaccagtaccagaatgtcttggaggaatccgattcggtgaagttggtcaaggacgtcggaaacgtcgtgcaggtcttctccggcgatgatcacgactactgccagctggttcattccgagtcgcagggcaatgtgcccgagatcacggtcaagagcatgagcatggccatgggtgtgccgacaccgggtttcctcatggtcagcctctacaacccggtggatgaggatggaaaccgcatccccggcgcgccagagacgacgctgcaaacacacctgtgtctgctgccgaatcaaatacacacgtacatcaagtacgtcgccttcatcatcctgagccttgtggtcctcatcctccgggccgttctcgtgccgattctgggtctgagcccgttcgcgctggagaagaacgacattcccgaattcaagtacagcaacaccctcccgatatccaccaaggataaggtcgagccccccgatctacggtcacctacgctggggtcatcgtccacatccatgtggcatggagcaggcaattccaccctctcgtccaacgggcgatggcagcctgcccagaaaggcaaacgtcggtggacgaacggcccgcggatcaatctcgacgaggcattctacgacccgcggcagacagaggtcgggagcagcaagacactgggcgttgttggcaaggagatctggaccactgtctggagagtcgcgtggatgacggtcctgttctggatctacctggccagagagaagtgatgaaatgattcttgcacgcccacagccagtggccatgctttgatctcttcctcaagaccgggttttgtattctacactaatgtactgttgatgagtcctagggtcaggggatacatatttataaaaaagacgggtgattttgcatttacagcgttgggaagcatcgagtctatggtatatttggggccttttcagggtgctctctctctctctctctctctctctctccctccctccctccctccctccttcaggaatatagacaagcggcacgatatcagttccatagtttctccaagatattgtgtaataattaccaagtttgcgtgtaatggaaatccggcacacctcggatggccgcaagatcctgatctcgtgtacaatcccagcttctcattccaaccctgcttcttgcgtttggattcgaggcccttcaggatcaaaccagagaacactactttgggtcaatagcacgcattccaggggaccacatcacatgttgtcgcgggggggggccacgaggaaggaataaaggcgggaggatcgccccaagctaggggcgttttgatatacgagaccaccaaatctgggaagagtcgcctcaaagcacacacctccccccccccaaaaaaaaaaaagatgggcaggaggctggacagagatgcctacatacacgtgcatggaaaaaaaggacccggccctgaatcctctttcgcccgggtccgatcctccgagaatagcaccgcaccgctgcgtcccgggaagccctctcaggaacaacccgaggagctgggccgcagtcgagaaacaaaacgatttctggggacaatggacaaaacaaaaggacaaggccaggattttgggtgtggctaagtgcgattcatcacaaggggcgaacttttcagaccaaaaagcgaaggtagaaaacaatagagttgcttgatccaggcttggtgctgtttaataagaaaggcaaggggaacgaacaaacaaccctcccctagcccaaaacgagaataaacgaaacaaaaggcaaaaagaagaagcaaccttcccgatcaagcaccgcgtctcctccccacgccgattctctcctcgcgtgcccgccgaagcacgtcctcggcgctggggctgccggaggcggtggtgccatcctgcccctgctgctgctgccgttgctgctggtcgagggcgatggcctcgcggctgcggcggtcctcgtaggccgcgacgtcctcggacgtgatggtgagggaagtggccgggcggcgaagcatggttatctcctgtttgtcccttgcggctcttcttcttgtttttgtctccctttggtgattgttggcgaggggggagggggggggttttttccttggcggtgaggatcgacagtggtttgattctccgtcccgctatcttcctggccttgacttgttttcttgggggtgcctggctttactcggtttgctcttcttggataacctagccaaaagggttgtgtgggttgaggaagtgtccctgtgtaagaagacggtgtggggggaggcagatgtgtgttggtgttggcgcttgttctgtctgtcccgccaaagtggaagaaacagcgcttgttggtttggctacgagcaaccaacaaacatcaactcgccctccatcttaatttagagcaccgcgcccaacaggacagggcctttctcccgagtgggctgtattagtcaatgccatccatgggcaaaaacgcaggtcaatatattaaattcccggcttacgttggggacgggaccccccctcggctcttgcaaggcggctcagctcggggcctggcctggcctaaaaataaggaactgcatttgcatgcatgcatgtattctcacagcctcccgcaaagccccacgcgaccgtctcgcatttgttggtgctggctaacctcaccctcgccaggcagccatttgagagtcccccccccccttgcaccataggataggatagtgtagaggattgcatagtgcagaccaccactgcaagcaagccatggatgttgtcacagaactcggcgcggtggcgtgggttgtctcaccagttggtggtgagggggagcatcagtgagcgatcctcacgcgattgcgcggggctgcatacagccctagatgtcacgtagtcaaggtagtatcgagtccaagaggcgcatccagcctccgcctcccacacgtgtttcactgctgcagatctggcgccaaggcatatcgctgtcgagaatcgacgcgatgctgcgctgacgtctgggatggtatcaggaaggttgcaaattggtcaaggcacgcctcccgagtgaagtctaagctctccccggcgatcagccctatgtctgtttgtcaaatcaaagttagtcagtatgaggatatacgcgggcatcgcatcaagcatcacaagtagacagagaacaatgaaaattaagtttgtttgaaattcgatttttgtatttttatatccgtcttttggactaataaataaatcaaatgccagaggatcaatggaaatgctcattgtcatggcttgttaacgtagatgtgtacacgccgctctttgggttccctcataaacagtttggtatcattatagacataggaaagaaagccagaccagtttggaatgccagcataaaataaaaaggggagaagagaaagggaaaagaagcgaaatcaagaacctccgcgtgcattatgctatgacgccggaccggttcggctaaagagcaggatgaaaaaaaataaaggtgaaaaaaaagaaacagagaaaagaagcagaataaacgagttggctatgtgacccaaatatgcatggtttgaatcaacgccgtatttcccatgatcaaactccgtgtatggccgggttagacaaagaaaaaaggacatagggaatatgtattgtaatagtttgcgataccagcttcggaaagcggttgcgaatagtaggcaacattgtgtttaatgagccccgtagtaaccaacgccaaaggcttgtgcctcccattggaggaagtcgcccaggtcgttgtgtagattgtagcccatctgggcttgctcctcgtggtggaagtcatcatcgaggacgtcgccatcgtcgccgccaagaaccaaaggctccattgggctgcggggggatacgacagatcgaggtgatgcgatgccctgctttgggtcggcgtgcatgagcgccataggtgggggggtagatgcgcggttcatcttgggtgcaccgtccagtgtccatgagcgcaggccggtgcttcggaaaaacttggtgctatcgaactggctggcatcggggtgggagaacagaggctgtggctcgtcgcaagatgcgattgacaagtctccttcggattcaaccgaggagattgtgctgtgggaagatcgcggtgaagggataagctccgggatgagcataccagcatgctcgaagccgaagtggtcaaaccatgaagcaatctcctcggtaagccggatgtcctcgtcctcgaacatatcgctgtccatgtcgccagcaccaaggatggccatctggaaggcagtccagtccagggtctcatccatcgtcacggcggccttgtcggccttgggaagggtgattcgtccatggcggaatgcggggagggtaagggagaagggagtgctcttgaggtaaatatgatcctcatcctcctcaggcaaaaactcgtcgctgaattttctcttgagtttggcacccttgggaaggtcagggagcttctgggtgggcggcgctctcaagggggcgatgaactctgcctcggcaccctcaggaacggccaggaggtcgacagtggcgaggcctctgtcagtttcatcgcccaacacgtgggcaatgttggcatcctcctggacgtaatcgctagagaggagaggcgagacagcaaattgagctggctggtccgatcctgaaggtgatccaaatgactgaggtgacaactcgggagtgacgattgaggcattggcaatggccagtgcggtagcttccctagcatcttgctcacggagagcagcagccttggctgcggcagcctcgagctccagcttggccagtgtttctctctttacggcctcgtggcactccttgttgttctttgcaatttgcttccttcggaccatctcgcgttccttcttcaagagggcaagctgctgaggcgtaagcatctcgtcgacctcgactttgcggaagcctttgccggtgaagagatcggtcatgttatcaggcagcgcccagcgtgcgacttttgaagtgacaggtcgagcccacgactttccttcgccggagccgctcttgttgcgagtgtggcccttcttcatggtgctttcatggcgaccgattctggggagtcgggggctcatcttggaaggtttaggtaggggaggtgtcatattatgcgagacgtttagcaggtgtttttgggtagtaggagtgagaaccgttgtgggagtgatgggcaaagccttatccaacgatgcctttcgcacagcgatcgggggcggtacagagcgtgattttctcctctcacccaagtcggggatggcctgttccctgggtttccgggtgggaaggtcttgcgagggtctggcctcctgctctgattcctcgggttgctcctcctcgactggtggctgttgtggctcggttggttcctcttccaccactacttcctcctcctcgtcttcgtcctcctcttgctcttcttcctcggactcggattcatcctgaggagggtgaactaccagcctaggagagacgagttcggggttggagatattcaagtgaccgtcgaggaacacggactcctcgaatcgagggagatctaggctcgtggagaaaccgcccagagaagatccaccgaattcgaatgcttgatccgtttccatgatgagctgtcggacaccctccgaccattctctagcgtagggtgtgctattcatcggtactaccgttaatgatagtgatgagtggtttgagtttaggttgagaggctctatttgaggcgacttgaaggccgagatggttggtgagggacttcgaagaaaggagtccattacttcctcctcttcctcttcctcctcctcttcttcttcctcctcatcatggtcctcgatctccatctcctcctcctcgatcacttcagtctcctcctcctgcactctgggcgcatccattgatcgcttggaatggtcaaggtgagacatgtctaagaggggactccgaggtcgctccggtactgttgatgatggacccgagcccgaaccagatcgtcgccggggagttgtgatttgaggagagggtgctgtctggatgggtgctgagatggtgaggcgagtccttacaccctcggactgatgtcgttggtgagctgctaagtagtgttgttgtaatgtactccggccggcgtccacgctactccgaactgatacactgggtgatgctgatcctcttcgtgttgccatgagggaggccaggctcttctttgatagttgagatagtgatgaatgttctgagaatgaaacggcttcctcctcgggaatgtcctcggtgtgtttgcgcgtctgtatcagctttcttaagctaaaagctggggcgcccatgttggaaggcatgatgtcgcgctaccgctctgcggtgaggggatgtgtttcagtgtaagttgcttgactctattatgggaaaggaaaggaaggaagaggatggatcatggtatgtaggcgatcgaaggaagaaaagggaaacaaagacaaggccgaaacgctgggatatcgcgtgatggatcctgtcagtgcgtagggacaatgaattgttggtagagggtatcgtgttggcagctggacccgggaatctcgaagcccatcggccaacggaacatgatatgtaagatggatagaagagatcagaaaataggtctctgggtccgggacaagaatccgttggggggaggggaagagctttgaatagtatcagatcagatggggacccgtcagtaagcagcgctgtattagggaaagggcgatgaggggagtgcggtctgcggcattgcagagacggacgagggccagctaaggcagagagcgagcatcaaggtgataactgggggccatggtgcgaagatgggtggcgaggcgcaatggcgaaggccctgttcgatgcggacggcagcgggacatgctcgatggggtgggagaaatgcacgacgcacgaagctggggtggtggttggtgcgttgggcccttgggatcgaggatgtgagcggagtcttggtgccaggtgagctgagctgagctgagttgatggaaggatggatttagtcgagggacaaggaggggggtagggcgtgtgtctacgagcagcaccgaggcggggcggatccccgtgccttagcgggcggcggtgtgtacctcgccatacagcagctgcgggcgcggtacatggtgcactctgccattgttctagtgggctaaattgactgcatagcagaccggttattactagtccagcggtctcgaaacccactggcttggcttccagtgtctttatttaacccagctagctgctttgcgcatgggcaggtcgtgaattgcagcccgggaagggaaatggtcctaaaataaagtcaatgggcatagcacactgcatgcgcaaggcaagcaaagcctcgacgggcgatggcccctcgtatctgctgtgacgacggtctggcaatgggaagggatttgcgcactgcgccagagggtggtgggtatgcgacagaggcgttgacgtcgccctacaggtgtattaatttcgtatcgcgggcagtgggaaatctctcagggacaaaacgtcactgcctggagctcccttaggatccccccctccctcgcactcgaggccgacgctcgatgggcgagctggcaaattgtcagggccggcactttgccagggaaaagcccccaatgcgtaagtgaaggaatgaaaagtgcagggcccccctctcaaaagccgtcccaccccgaccagttgacgtactcggctgctgcaccagacaccacctcgaatccttcgggcatcgggctgacgttacctagcctcctctggttggctgtggcccatattcggtttgtcatgaacaggccccttccccattggggaagtcgattcattttcttgctttcgacaccagagcagcctccagctctgcgctgtacagcatcgtaagttagtgcgtattcgtaaggtgtgtgcctcttggcagctgcatctatctccaggagggacacacatgcgcacactctctctccacgccgctctcggtggccaaagtggtgggtagattcgtccgtcatcagtggccgactcgcagctcccgaccccccgggaccactaaggtgctgaggccatcaagcgttcatgcatttgcttttttttctcctttgatttgcttactcacttccgattcactcccagttcgttttgccggtgagagcggaatgttaatattacatagtacatacacagtcagcaagcacaggttcaatcccggacctggagcgtgcgccggggtttgccaaattagatagacgaaattccctaatccggcattgaaaaaatcgtatactccagattatcgtgaactgcgtcacggaatgactaggcagcgcaagtcagcccttatttcctgtccgcctttgcgttttcaccgttgggcttcaggcacggaaatggaagccaccagcaatggattaattacccgtggggtcatgccgtaagactccatcatactatcatccagtgacaaagggcctggcaggagctaacgcaccaagcaatcggctaggctattacttgctccagttgccttacctcgctgccggcggtaccgttgggtggggcttgccgtttgcttgccttgcctcagctacggccctgcgctactgaggaaggctaattagctagtgccttacctaaggtagcatgctgttgacagctggaggtgtcctatcgcatccgactgccaccaagccagcgctggatcgccaacagcacatgtgtgcatgacggctgagccagaagttcctccagttggcggctagtaccacccggatcatcccactatccaacaactgcgcatccaagcgagttgggtgggagctcagctggcgcgatgggagcgcagcgcgtcaatccagagcatgcagggcgggtattctcgtctgttggtggttgcatcgcctctgggcgcctactgtctcgacctgagggcggcaccgaaccgcaccgcccccaacatcgacacatcttactcgtgtgacttttgccctcttgcccagcatctcgccagctatccgtctcgaaagtcccaatactgcatatgccggcgtccaatagtacagcatcttgcaaatgcatctcggatgtagggacgcagtagtcgtctcttttggtgtctggtggtgaccttctgcgccactcgattttgggattcgctgcaagagtgagttcaattgcctattgcactcatgcccgagctacagatggcatgtatttagcccaccaatcagtacccgacaatcattacggcaaacaggtatgcgaacatgaaggtgtgcgaactgctgatggggccgacccctgccattcgcattgcccttcacagtgacagccgtctcctcatcctcgttccacagaggatcttgtatccgctcgcgggtctgtctacgtgaccagccggtgggggccaattactatcatgaagtagaaaaaaaattgttcgtctatagcaccgctgctaagaattcgaaagggtgaaagaatgggcacagagggagaaacgcgttggcccatgtggtgttccagccaacagaatgttagacaagagacaatcccccggttacccagagagtagtatagcgcggaaaacgaaacagcatcacgcaatgcaactacgactccctacctccagcaagcaagcacacctacatttcataccaccgtggcatgtgtgattggccagccgaggccaccccgagatcagcgtgccctcggccacaggcagggcgagcccagccgagaacaaggcgagggagatgaaatgctggaaatcgcatgaggggtccacagatggacgaaggctcgctctattgcctgcattgcctagcgctccgagccatggatacagacctgccgaccgagatgcctactgcctaattcacgacatgttaatcggcgcgaccatgaggcacaggcaagcggctcatccgttgctccattgccctttgcctctcgccccaaggctagcaggtgttcgtgggtagcctcagccaagcctggagacggccccctctgctcgctatcacgttgcgtccagtcattggcgttgcgggtggaaggatggctgggccagagctagcgccgagaaggaatcgatcgattctggatacctcaaatcctaatccggcagctagcagagaggcaggcgattgacggtagggtccgtcctgtggatgtcgctgtgccttttcgccaaagctgccgtgaggagaaggtagccttggggcaaagacgggccagaccatgtgtcttgtcagtcggacggcaccatctaatctccgcgccctcggcctgcgcgaccagagggcagccatcgagctatcaacctgatacacatccacaagttagagtgcaccaggagagcatccccaggtacagaatggagcgtgattgctgtggtgcaacccaccagttgtggcaatagagtgggatttggggaccagctaaaggcaattgagatggcttctgcaacacgaggacaccaccaccggccactggaaacagggccccgggcgatgtgccgctgatctgctacacgccgtcaatgcaactgtatcagaatgcctatattacatgtttggggaaactcccgagaaaccaccatcgtctgatctctttcccatcacattcatttcccttcctcacctcttcgcttccgcagacctcaccttatctggcccgcgacagctgcaacgtgggaaccaccacacaccagatccagctgcttcgggtgcggaggccaccattgccggtccggttcagcgccgtcgcacgtcaatcccattgagctgtcttgtcctgtcctttttcccccaagttttcgagcgatccactggccgctgtcaactacccctgatgcggatagcttcatcttcaccgactcagcatatcgcgctgtcagctctctagctctgctgctgggcttcgcataccgggcttgacgtaaatccgcttctttgtccttatcacatgacgataagtcggtttccatgccctcgtcattggtgcgctgctgtgttggtgcgtattactgtccagcccgcgcacaccccgtaatacggtccccagacccagggattttccacacccccagccccctgccctgagccaatccttggtcccaaggagatgcacaacagctgttagtaagacgcctatcaatgggaaatgccgtccacgttgacccctacccactcatcgtctcccaagcacgattccacccagggccgccctgcccgcatccggtaaatccaaaccgctaagttgttggttcgtgggcttcatgccaaaaataaaagagaaacaacatgccaaactatcccggcttcgatcatggaccacgttttccatcttggcatctactcatccaattccccggtgcagacggacgttggaaatagcaacaaagaggggaaaagaagaataaacatcaccacgtttttctcgttccccataggtttaaatcgtagattgggataaccggtgtggtggttttttttagaaccacacagccttgcagtgctatcctctccttcgggttcgtctagtactgtttgttggtcccgtactgttggtccgtacacttccgttggtttaagggcccgtatggcccccccgttggtgatttcaacatctcagccctctgcctgacgtcgtccgcaggcacgacaaggcggcccggctgggcacgtagccctccatctccgagtcgcaccacgaggcgccagagggggaccgcttgtgcctggagcaccactcctccccctcgatcctctgacactcgagcagcggctcgtgctcctcgtcctcgtggcggcgcgctccccccgcagccacggcggcctggttcctgcttctcctgcagctgccacaggcggtgccccagcagcccgcgaaccagtcagtgacggtccggagccaggcgtgcggcctcgctgacgtagtggtggtggtcatccagtgcccgcttcgggacctggtcgtaagcctgggctgatctttccgatgcaggaatccggagagcgagtgcatgctgggctgaattcttgctcgtaaggcttagtggttgctaccttgaatgcgcggatgtaacacccaaacgtagaatggggatatcaattgatatacgatgggtacacgataggcgaggaagataaattggtgatgggcgacgatcaagcctgaggtagttacacatctcgacatcatatcgtgaaccagcgcgcctcttataacttaaaagaaaagaaacgacatcagagacacaaggcatctggccccctcgagtcgcgtccatgggatgactctccatcctcgcgatgcaatgtgcttcgaatcatgatggctgatcattccacccatagggtagcatcggccttccgattgctgaccccctcgcataggtctcagacaatatttgccgagacttacatgaaagctagtcttgatgtagggtaaggtcttagagcgacaaaagaaacaccaatcagcagtaagaaactttaagacatgatctagctttccgtggaaaccgacgcaggcccagcgtcccaatggcatcaccaggctgggagtggtatggagaatgcgccggcggctgggggcaaacctgtcacaccaatcgggagagtagaatcgcgaaagaagatatatggagagatgtctactacttcagccactttacacggtaaatccattccagccggcaacccttcccagaccaaccttgccttacaattcctcaacatcccctccgccgtcctcatctccgtcattctggatgaatggcacgaaccgaaagtccaagaaactgtgcttatccccctctgttattaccatgagctgcagattgagaacgccctgccggtctccgcgaaggctgaccttgctggcgatacgcatcccttccgtagagtgtttaatgaaatcgaacttgtaactctgcgaaaaccgttcctgaatgctgaaggtctccatcagatccctcccgcgtgcaaagtcgacggccgagctgccgagatccccaacacccgccaaagagagatatggtgatcccctagacgccgtgagagtcaacctgctggggctggtcggcgtaatctccgacagagaatcaaggagggagcgtgcctgcattataattttgaagctcatgtcgtcgcggtcaaagggaatctcatcaggaatctcagggacgtatgtcgtaagtgcggccgtggtcttgacgcccgattcctcaatggttatcttgaacgaatccccctcctccgtgtaaagaaaagtgcacgtcccagccaggccgagagcatggttactgaaagcatcagggcgataattgcggaaattacttcggtaagagtcttgatctgccttctgtgctcgtgtcgccacgtccacagcgccgaaaatctggagaacctccaggagagagccgagtgggatttgaaagttcacaggcgcaggagcttcttcaccctcgtccctcggtagattaacagtgtaagaataaaagagatcggaaccaagaaatgaaacacctatcggagcttgtgagaaattgtcacgttgacatcagggggacaaacagggaaatgcacaccttgcatcacacgtgagaggtccgacgtaaaacgtataccctgctcggtgatttgaacgtgcactcttggggcaaagtcgatgcagcggaggagttggtacaaaggccgcgtggacgttgcaacggcccggaagatgggtggattttcagtcgccattttctaaggaaccctgagtagtgtccagagtgttatgtcgattctgaaatgagaaatgaaataatgaaatggtgaaatggtgaaatggaaaatataggcgttcgttcaatggctttcttctggtcttcaactattgtacagtggccgaaccgagcttcttctcgggtgcttcttctcgaaaagggtatctcaaacgtaaactccgactgcgcagaacatatacaccgttccaaccctatttagcttgtgagtatggttttcatgttgtttctaaggcgagaacggggtgagacgaacgcaatagctgctgaggcagggacacccaagagcgggacgttaagtagtgaacggtctaaggggaaccatttagcttcaatgtcgaaagaaatggaaggagctatccttgtcaggaacctactcagcgcaaagtagcctgtcaatgcgactccaatgaggagcagcaagaatccgacggtgaactggctctccttgccaattgtgggaagaaagggactgccagcagcagcttgccagacctcatgcagggaagaatccatatgtgactaacgtgagaccgaatagtttatcgaattcgattggcgggagatggcgctttcaatgggtagacgtggcaatggggaggccgcagataatgagcttctggtgaagttggaggtttcgttcatcagcaaagggccagcagctgtttaccattatcgacatctggccgataacccaaataggcttagaacggatacgcggctataagctctaaccgcctgcggtagagtgtggggcacggtagacgggatatccaatttcattggctgacgggcccacgcctcgacatctgacgtcgcgactgagtaaagtactgaagcgggagctcgagatgcttctccatttgctatgcgacagcatccgcacacgcatgacgagccacagccgccgcatctcgagcagtgcgtccccagagcaacccacacaccatgactgtgaaggacgatggtaagcattcggatttcctacacacccgctacgcaaagcaccgcgctgacaccgtgccaggcgcaaaacgcaaggctgaggaggagccttcgtccccttcagcatcgaagcgcatcaagcaggaccaggatgccaccgaggaggtcgaccgaaaggccatgaagccaatcccattcccagagaaggtacgtcggcttacccttatacctaccacggcctgctcctaggcacccagtgctaacatcctcacccagccggccgtcatcgaagaacgaaatggcgaaatagaattccgcgtggtgaacaacgacggcgaccgcgagtctctcatcatcctcaccggcctgaagtgcatattccagaagcagctgcccaagatgcccaaggactacatcgcccgcctagtctatgaccgaacccatctctctatcgccatcgttaagaaacccttggaagtagttggcgggattacctacagaccgttcaagggacgtcgttttgccgaaatcgtattctgcgccatcagctccgaccagcaagtaaagggttacggtgctcatctcatgtcccatctgaaggactacgtcaaggccacgagcgacgtcatgcacttcctcacatacgccgacaactacgccatcggatacttcaagaagcaaggtttcaccaaggagatcacactcgaccgcagcgtgtggatgggctacatcaaagactacgagggaggaacaatcatgcagtgctccatgctgcctcgcatccggtacctcgagatggggcggatgctcctcaagcaaaaggaatgcgtccaggctaagatccgcgcatattcaaagtcacatctcgtccacgcgccccccaaggagtggaagaacggcatcaccgagatcaacccccttgacatcccggccatccgcgcgtccgggtggtcgccggacatggacgagctggcccgccagccccgccacggccccaactacaaccagctcctccacctcctcaacgacctgcagaaccacaacgccgcgtggccgttcctcgtcccggtcaaccgcgacgaggtggcggactactacgacgtcatcaaggagcccatggacctcagcaccatggagaacaagctcgaggcagaccagtactcgacgcccgaggacttcatcagggacgcgaggctgatcttcgagaactgccggaaatacaacaacgagagcacgccgtacgccaagtcggccaacaagctggagaagttcatgtggcagcagattaaagctgtccccgagtggtcgcatctggaacctgagaagtagagcagcctcacgttcagcccgactgaactcaataacaacaccaccaccaagttgaacaacaacaagaacaagaacaaggacaagaagctaaagcagaagcagaagagcaagccgaggcggcttgcggggaggagggcaactgcatcatcatggagctagggatccatgaaacacgactgtaacgttgttatgtgttttctagcattggaagattcctgatctgggtcggggagcggcatagaggtctatgattttttaaggggaaaaggcacatggagttaattcggaattcccttttagacactaagcaaggcgttgggaagtgacatctaggcacgcggttagggaaaatgtttctttgaagatacttgtattgctcgttgctctctaatcgcgagcggtcgacgcgccagaaggaaattacaaaaagaaggaagaaaaaaaaaaagccgatacgaaatcccatacgcaatcgcttctatcaaagaatgtcccaaatatagtcccgttcgattttccagctctccccttttcgtggggagctttcgctagagataaacaatcgaaatatcttgcctgcttgatttccttccctaggttgatcgcccaaactccgttgccagtcccagttgaaaagagacggctgattctgcttactctccgattatgtttgctcttgctgcgtcccatcattcaactccttcaagcatccattgccttggtcaaacagcctttgtggccttagaaacccaaggtacgcgcataaaataacatgtattttcgcttctcggtctcggcaaatacgatttgatctgcgagcgaggcacgtagtcatcatcatagtgtaaccgtaagcaagtctcaagacctcagtgccccaggcgctccggccgacctgcggctagacgttgactcccccacggttggcaaccgcaagccagacaatctggtagtagccgggctccacgacgccctgatacgggagctgcggtactcctgcgcggcagcactggctgtttctgaccgcagagagcgacgcaaaatgggctgcagacgctcggggatctccgaccactggccggcgcgagcggccgagaccatattgactggaatcagaccggtagggacaactgtagattccagcagctgacgaaacgcctgttcagtcatatcgtcgtggatcagtcccgactcgagcgcgttcttaaaccattgctcccactcctcgtcaagaacagcggaagtgtcgccagcctctcggcgagcggcgccggcccgaagccgctggttgagttctatgccgacgctctccagctcgtcatcgctctgctcctcctcatcctcgtcgggcgatgtctcgtcgtcttcctcgtcccccagcacacggggttgcctgagcccgtacgacttcacgatgccatcctgctcgtcatcccattcggggatgtcatcggccgtagtgtcacggatcgtgataccctgctcgctctcgaacttctccttggcccactttgtcccctcccatctcgtcaaccccgcgatctcggcgggcgtcaagcccagctcatcaaacgcgcggaacagcttggtgtgccatggccagcggcggagacggatgcggtgcgtcttgtgcgtgtagtccagaccggggtacttggcttcctgggtgtcgaggtggccgtagaaggcctgtgtctcttggcggacctcggggatgaggtttcgagtgagcagtgcctggaagttctgggggtcgttcgctttggctttggggaaaatgaactcgtaaacgagcttctcgacggaacggcccctcatttcggcggctttgttgacagtgactctgctggcggtaggagagtggcgatcggtggcttaacgtgcttattgcgtgtctttgtggtgtcttaatgatcacggcggagcggttttcggaggaaggcgacgctagggtgtagccggcagtgagattgcgaatgagagaagagggtgaagtgcaggcttggggagatcgaaaaccccgcctatatagggtgcgttgagagtttgcaaactcgctgtgctttgaacgggcggtccaactaaaggcaaacaccagacagggccaacaaagcgtcagtcagcagctccacgatcgtggtgaagttgccgggcgtggcctgggaaagttctggagaagggggtgggggggctggaggccaagaacggcgagtaaagttgggccgagctcgcgatggtcgtgatgtccgcgctggcttttatgggcaacaaagggggaatgcacacagacggcggcaacgtattgtcaagaaaaccaggcaggtgcgagcaaggaatggaagaagcaaagaagccaaaaaaaaccaagacacggcctggagcctgacgggaatccaaaggcacctggacggcagcacaggattggaccggtccgggcttggattttcagggcacaccaccccctggacgaggctttggggaggcgctacgctaactggccagtcaactgattacgaggcagccattggatgggaggtttgcatccatccaaggaaaagagtgcctagcagcttcccgtgctcctccctagccccattgcttaggctccaatgggaacgttatctggagagcaggcagctggctgacataaaccagcatatgtacattgaggccgtcgacattgcatccgacacggcatcattgcggctagtatacctcacataaagttgcaaagacttcgaactcaggatcttattgtctgctcatcattgtcaattagcgacctcgagtcaacagatagtgtccattttagcgcctcagcgctggaagtcgcgttgtctcaagttctatgtcaccctgttggaggggtccgagaaggtgggcccctcctccggggcgtcctcgagtcccactgatggatcatggcggcggcgtctgttccagtcagattcagggagcaggcagatcaaatcaatgtcttttgatttagccgcctccgaccggcgctgtgataccacccactgctggctacccgatacctgccccatagcactctcgaggcatgcgatgaaccttgtgaatcaacaatgtcgtgaaatgttgtcactgcgtactgtacttgcctgtttgatcactcgtatctgttgtgatccttgggatcgggaattcacaggttgctaccggttcacgaccagagaagcggacccgacgttgcggacaatgcacgtacgacgttgagaatggctgaccaaactgagctcaatttcacatcacaacttgtataacgcaaaaagttattcggtgaggctacacatgtccaaccactcattttctgcaccaagacacaattggaagatagcaaagcacccaagtaggtcacaaaatgcagcgtgaagactgctgcatacctacctatacctacattgcgtccctgttgaccagcccgttcggacaccggaggagtgaaggcctgcctagacccaccaggtgcttgtcacgaccgcgggcatgcatgtgcactctcatcgttaacaggatcaggcaagtcagattcctggaagttgagagcctccgtattcatttgcaaaaggtgaggtatctaaggtgaatgcagggatgtcatcttattctatgtagacatgagtcctcccagcccctgaaaatagcaagcaagtgcttgcaagtaaaaaaaaaaaaaaacagaaagccaaacaaactcccccatcgatactgcccacagtatcggaatagagccattatttattctgtcgtcaacatgtgcgaaatccaagatgcttgcttgttatgctcatcacgaggagtctcctcccgaccctcttctaaatacgccgaaaaaaaagtagagatgttcccgttctctggtgtttgatcaatatgcacgttcgtagtgtctcccaggcgcgcccattactgggctcgagttgttccgatcatcgtacggccgtctatcccaccgtgccctttcctctctggcacgacttctatccctctccctgggatcccagccctgactttcccgacgccgatcaatatcggcatggctgcttgttcttctatgggcttctggcctccgtagattttgctgtcgctgtcttcggcctccgtggcctacatcatcatcgagctcattgtccaggacgtatggccgtgacttgtcggagtaccgatccctctcgcgttccctctcgcgttccctctcacgatcctctcgcgcccgagcccttctgcccacttcatcctcggaatctgagccgggactcccggcagactcgctgtctgggaattcacgctgaagccgcgagggcggagctctctgatgtggacttctgcgggcacgagccgagtcatatgatcccggcctggagtccggctggggacgtcgctcagcccctcgaccagtgccgataggagcgcccgggaagatgtgggccaccttctcactcacccgctctctgataccgagtcgaggactgctccctgcgcgcctcttcagttcctccatacgaggctccgacggtctgggactacgaccggggttgggtgagggctgtacagatggggggtaccgcctgttgtgaggtacctgtggtgagttctgtggtcttcggttgggctgctcctcgtcatcagaggaatcagagccaagtggtcgaggatggctgtttcgtcgtgcctgtgtagatggtcgtcgtaaattggcatccgctgaaggggcgggaggtgggtatgagtgtgaggggaagttttcttgtgtagttgaggatgggtagtcggagaagcttcttcgtcgttcacgttcgcgcgagggcgggctttcgcgacgaggtatttccggcgttctgctcggcattcggccagtcgagtggtgtgcggccgctgaaggccgtggcggtccatgtacgtgggtaaatgagactgggcgttgtcctctggggtacgggtggccgtccgcattcttgggataagcaaacttgggacccgacgatgtctcaggtgtaggttcggatttcgtcaccttgggcagatcctcgctcgacgcctccttccacagattggccgcgcagtcctcatgccagcgatcgacgtcggggtcaggctgagctgggaatacgttcttgggtagatcagaggggaaaacctctccggtttcgaggttcttcaagttccagttcttgacagcgtactgcaaaaatggtacatgctcttcgggacccagaaggatttcgagagactcccatcgagagaagcctctggacgtcaaggcggggatcgagggtggcgcgtaatcgttgtccgtgggttgtaaggaatgctggcagccagtgagctgccacatggaagatatcgtatggtcgtctttgtcgaagagtgctgtgaagagagagcctgggttagcgacatgctccatcgtaagtaaagatacagccaatgctcacaatcgtagtcgccaccgacggccttgtagaaagcggccaattttttcggggttagatgcggatcgtttctgtcaccgatctcgcgcgtctgatacagagttgccgttagcaggcagcaaggttggagggtcaagaaagcagacgagggacggagggcggcagggttcgatgacggactgggtacatacaatataatgtgcgatggctcttaataatgcgtcgagctgtttggtaggggcattgttgccttcgaacatccaggtgtactgcatactcgagggcttcgagtcttgcgacggcggcgcatcgccgctggctgacttcatggtgatggatgtgtggttgggaaggccttaaaacggcgcggggccggtgcttgaagatgcagagagtgtgtaccaggtggccggcatcaggcgggcagtcaaacctccagccagaaaatggagaaggaacaggcgggtgagcagatcgatctatgtatgtatgtatgcaggtcagaatgagtggcgcacacgagctgctaagtcgagggatcgtcgagattgggtatgctgccgtgactcgcctctgcggtttcactcttacgggcattcgttcatggtattgtttgcctccagcacccaagcagtaagcgctggccctcggatacctaggctcccaccccggtgccaggtcccttcctagctggccagtattgtgagatggatgggcagatcgatgtgactagctgtgcctagcagcagtggagagtggtcaggtctgttggtaataatggacagcccaacggagtcccgtcgggggctgacacgtgcatccttgtttcgacgcttttccaacataccgccggagggtgcgcacacttgatgcacaatgcgtttgatgcatgcatgcctccgtctgccttactaagtgacctctacgctgtgcctgcgatgtatggaagtctgtggaatcctcacgtatgacgcatctgcttccgtcccatcagggagctctgggacaaaaccatttagacagcgagaacgaagatagcttcattgtcattctagtctgattgagccaggcgattcagcctaacctaacgacgaggacatttaccaaaccgccaaccttggcatgggactgtcgcttcatagcaggcccaattaagggccgcattttggcgtcgtcttggtctggggcttggaacaatggggtaatcgctgccttggtgtaggcccctctccaggcgcctactacccgtagcaatgcgcggaccgtggacgttaatagaaatggatgggatcgccggtgacacagcaaggtacagcgagcgctgagtgactaatgccaccttgccctccctgctaaggtaatcgcagaggtgatgaatacaccctgctgagcctctctgcgaccgaaccacaggccctattgcgactgtgacagcggtcacaaatgggattctgcaaggcgcagctccagcaatcccgctttcgcgtcctgcgtcgtgcttctgccgacagatgcaaagtggcatccgggccgtcatacctggctcgaagcaggaaataagcgcatgctggcctcatgccaaacccacctgatgtcatcaggatgctctctgttgggtgattgtgagaactgactgcttgacatggactcgatacgtagtggccggtggggggacggcaggcagctaaggctgggcagccaacagcccaccaagcccacctgctaggggacatggtgctggggttcgcgtgccttccatgaaccgtgttcagaattcttttgtcggctgaccattgatcagctttgactgctcgtttgtcaaccaccaccacaaattctcccgacagaggcaattccaaggatctctcggccgatcactcatccaccctcaagaccacaccttcccgttcttgccgaaaagtcgcccagcatggatgtgcttcgctccgccgtccagcccatcacccacaacctcccggcgcctatccgcgaccttggagtgtccatcatcggcgagacctgctacaagacgctgctcctcgatgtgaacctccaggatgtggattgcctcaagctcgccataagcaagggcctgggaattggtattattgccgcctcgtccatcgtcaaggtcccccagattctcaagctcctcaactccaagtcggccgctggcgtgtccttcctctcctacctcctcgagacgagcgcctacctgatctctctggcctacaacttccgaaacggattccctttcagcacatacggcgagactgccctgatcctcggtcagaatgtcatcatctcggtcctggtcctgaactacagcggacgggcgagctatgccgcggttctcgttgccgcccttgctggagctatcggtgccctcttcaccgagaatgtgttcaacatgcagacactgagctacctgcaggcaggcgcagcagctctcggtgttgccagcaagctgccgcagatcgctgccatctaccagcagggcggaactggccagctcagcgcttttgctgtaagtaaccccctggtctacgccatgatgtttcattcctccgttcacagctaatccatcaataggtcttcaactaccttgctggttccctctcccgcatcttcaccactctccaagaggttgacgataagctcattcttttcagctgtgtctccggtttcatcctcaatgccgtccttgccttgcagatggccttctactggaacgcaccctccgagaaagccaagggaaagcgcaaggcggtccccattgaggctgcctctgccaccaactcaagcactcctacaaagaagggcccaactactcgccgacgcggttgatttctttaccaagataaatctttattatgtcttaatatatcattttcctcatttgaaatcaatgaatgatctcttttaacttattgattcgtgtaattgtatgtggtaaatctttaccaatacacatgattataattgatccgatgcgtgaagtgacaagccccaaaaagcacacgctcccgatgaatccctgaaataccctgccatgaacaccacaagcgccaaaaccgatggagaacgccgattcccttccaaaccacagttgcccaaacccttcaaaactccgatttcatgatccggcgccactcgacacgttccgctccgcactcagccggtccgactcagacgcggcccagcgcattgtaagcaccgcttctgctcgccgaggttgctcaccgagcagctgaagcagacgtgttttccgcatgctccgcaggccgtgtcgtcgtcaaccccgatggagtcgatgtccatcccatcgtcttggccggacgcccccaggccggcgccgcagtcctcgcacgcagttggggagaaactcgccatagccgtggtttcgattgtggctgagggtctcgagttgatgttccagaagcggtggagtgactgttgctgtcggccagatgtgctgttcagcgagagggattcgggtgccggctccgggaccatggccgggtgctgctgtgctgagtaaaggaggccaagggttcgttctgtagggagaggagaatgagtacgtgaagactgcatgagtcgaattgtaagataaaaacctacgatggacctcctcctcggaagggcggctgttgcgaaaccgtttcattgtgcggctgtgaaggagcggagatgtgatcatggacatcatcattgcccggtcgtgtggaggggagttggacaaggaggagctgggagagctcagggcagaggaaaaagatcgctttcgtttcaactccatggctgtatgtgtgaggatgaattatgagagacagtatgcccaattgagattgagatgaatataagtaagttttctattgtggtttagatgcggagggagagattgatagaatggggatcatctaatataaggcaagaggctggggcggcacagagtcagccggcaggggacgcgcccgtacacgcgactcgtaaccagcagcgcgttgagtgtttcgcgcgacaccccactggtaccccatgttatcaatggcatgaaaacaaattaagtatttgaagattgttattttcttttctattcttgacctatacttagacggcattcaacaacacgagcaataacactcgaattgcgatggccgcatcaccgtgctttgctcccccagtaggacggtttgcacttctccacctaagttccgacaacttgtgagggctgttgaagcgtccagggccattagtctcactggccgaaatgttacttgtagccccaatgtctggacgataacaccgagattatcagtccccctgtgccttgggcttccttgacttgaagcaaataaatttgccaatatatatcccacatcacccagcacgcatgctagctagcagggtggtttcggcaggcatgtttgttccagatcaaagttagtatttgaagatgcttcaagattgccattgcaagttggaaatctgcctttcgcgcgtcggacgtaattctttgagtagcagagcaagagttttaccttaaaaccgccgcgggaggccttcatcttcgaccgtaaggtctccggccataagatggtcggaaataccactcagaatatgtgctcgtatctgtcaaagagtggtcagcagactgcacaagcagccaagtaacccatcacctgaaattcagacacacctctgcggccgttgatcccaagctggtttgcaacattcacatagccctcgctgagtctgccctgcgacttggagacctgcttcgcagtgccctcgtcctcctcccacacactgcggcacattgggcacgtcggcctcccgattttcgaccgcgcccaggtctggaagcactcctggtgcatgttctggccgcaggcagcccggcaccatacgatggacttggggcgactcttgtcaaagtccgagaaacagatgggacagtcattatccagggatttgcgattcttgtcctgaggctcagatggagatgtcaaaataggtggggcggactggaagatctcgatgagttcggacttgagcagtgcgagctgatagacaagatgatacggcgcattaagcacctttttcataacctactctaggtcagcgcagatgtcccaaaacagaggagagaagtcaaacgaacaaatatgatatgtttgcactggtttcccttcttggaatgaggacagtcgcagcgaggcacaagcccgatgaagacagtatatatattgcccgttgagcctgtcagctcaacgatctcttctgggcagtcttccgtcccagctctcgtccgttccaggacaaagaatctctgcgaggtggcgcggtggagaatatcaccgaaactctgtggcggctgcggtctgaatcttcgtagcctcttttcggatgagggttctcgcgcaaccccatccttatttcccttggtggatgccggtgatgatggtggatgagctcgggttggggtggcaatggccctctttagtgatgatgcactccgaccctggcattcctcatcttgccggcgtctctttttcgaacttccagcaagaggctcatcttccgaagagtcctgtgtaagatcaataggagcataggcactgttgccaagaccggggcttggttctccattaacacctagttggcgtaagtgccgattcccggtttgtttgacgctccccatgattgcggtttctggcagggcgtgcgaacaacaataatttgggaattccgaaagtatccggaacagggtgatttactctgattctatgcgaagtaatgtcttgagggaggcaaatgcagcgaatgaatcatccattgtttgaagctgttgatgaggggtggtcacgtgctgaaccttctcatatctgcccttcagatgtgttgggcacctacgtgagtgacattaatggcacacgaaccataataagcacccaattaacgaagaagcggctaattcttagcagcaattaaaaggaacatgataaagcaacataatcccaagcatagacctaccctctagataagatgtccttcgctttattttcaaaatcacaagctcttgtttccgctttttgagcagagcgtcccgaatggagatcacttgaggaaatgcttgtggctcgcgtatcacagctcaatcacgctttcatatgaattttcaaaaggcgatttaaaaccaatatcatgtttcaatggtaaacatatataaggacaagcattctgcgttgtctctactactaatccaggtcttgaaatgaattcgtctccttttctccatggatccccccatgcccatattgaatcgcttatgctatcccaaagcgaataaaaagcaaccgtcaacgccacaggcacgtctgaaggccgaagccaggccttcccgtaaccaggaaaagtaaatgtccgcaagtggttcccttgcatatcgtctccccaagacacctgcccaataccagggcatccaagaagacagccgtatattgaagatacatacacaaataagggaaaagacaaaagaaaacaaggtgctcaagaatgataggcgtgccgtctcgataggtgacttgatgatggaatgaacgccaagtctattttgttgatggtggtagttgaggattaagaaaggagaaatgtgtgagcgactgagaatttatcgttggcggcatatcaacgaaatcgtatattatcatcatcgtatgtggtgtcggtttatcatggaagtgatcgacggttgttggcgtgtggtaaatggttgtgtatactagaacagctgttcatgtaaaagcggtggcggtagaataagaaaggctaaagaggtttaatggtaatcccgtcgatgatgtggggggtagggtggctgttggtgttggtattggcctcgaggttgtgccactgttccctgggaaccattttgtcgagctggctgctccgctggaagcttgtggtcttggccggggacagtctgttgtctgccaccgctggaagagctggctcctggaacaaggtcggttacggcttgtgcaatggtggcaaccacgtattctctgagctgaagatcttcttgctgatcttccttctcgagccggaagcgctcgtctttgttcatgttggctcggcgcaggttcttgatttcagccatgatgtagagtagcacctcctctgggcatcggtttctctcggttgcatgttccgccttacgaacgtatcgtcgagttacgtcagtcgcgccgtcaatggagaaggcgatgcagtaagacatcttcttgccccagccgttggtgtaaagctgtgggttatcccaagcttcctcgcacgcatcaacgtggacccatctgcgctggtgatcggagtaaacctccgtccagacatggtcctcggcgttccatacccatcgcacgcgaccgccgacggctctgcaaagcatgctaaagcagttcgcccactctcccactcttcctcggcgcgtctgaagcagtcgccacacatcaccgtatcgtgggaatcgctcgtaggcaccgcatgactggttcgagcacctgtacaactctactcgcaaagcgccacaggcactctcgtctggcgtgggtgtggtcatcccttgtgcgatggtaggagacaagcaaagctggcaaggagggttgtttacccatgtgaaaaatgaacgcttgaaccatctagagaatactggtcagaaggtggcctcgaacgagaagtaagagaaagaaacataccttagcagggctcgaataacgcagtcttggtagccccattccggtctccggccgtcgcccatactctccgcctcggcctgcaagacctgcgtctcctcctctgcctcgctgtaaatccgatcaagggggataatctgcaatgcctcatctaataatccagggttctcgtatttgccaggcgtcaacgatagaccgatgagcaggttgcggaatttttgtgagtctcgatcgtgtgctgcaggtgctgtggggatcttgggaagatggcgaagagccgagtaggatggaggagtcgttggtccgccagatgttgttggacgctcttgggagtggtggccaggtgctcggaggttggcactggaggcacgctcgcccaagcctggggttggtgaggcatgtcgagatgtgttacggaggtcattcattcgcttatcacgcaacaggccttcgaacttgatgcgtaggtcgtgagcccattcctctccataatccccgttggaaggggtattcgacccgaaatgcgtttcatggccggccatggtgggcggttgtgtccgtgatagccaggtccgacgttgaggggatatgtccaaatgtctaggggtgttcaggtaggcgatgtattaaatcctaggtgaggaacggcgacggagttctaaagtgttgcctgtgcgagctcgtcgtcgtgtgtggtgcgttctcgtcgtcgtcagctaggggattcgtaggcctcttcgagtttcgccacaggctcccctaagcgcctatcgtccagtgattggcccgcacctttaccagcggtatcgagagatctgagggcggacggttttttaaattgatcacaacctgtgctcaattcagagagacggtgatgcgcggctgcgatcgaagcgggttgtttgctgggaaaaggattctacctgtagtagtgtttgagatgggtaatggcgactaggaaggagggaggggccccggccagagcacatccataatggaccgcccgtggatggcaccatgggacggtctgcgtcgccttcgagcgtcttggtggtggtcgtttacgcgtcagctttgggctgcagccaatcagcagcgccgtgcatcgcctacaggggctccgcatagcccggcaggaagtacagctacttgtcccatttactaatagaatcgacgctgagcggcctcagcccttgtcccttagcagcccagtgctgcgtgcggttagcgtcatcactgccccgatgaggcagaaatagccaggtacccagcactttcctccgtaccagcgcgttggtcagtcatcctgatagaattgatccaaagatccaaaggagtcggtctacggcagctctcacattgagaatattcgcctgggtatcaggcttcactatccaggttcaacatggccagtgcagagctgccgggttgcccactccggcagcagatgctaggcagcagaggtacccttcagcttgcgagtacagatgttcggaatggggccagggcattagagttgggattgcgcagccgcaggggcaagtacctgtacctaccagctccatcatcagcaaacctagatgggcgatgacgaggcgctgacctgtcgtccaatttgagcgtggcacagcctgtgcgtgactttggcttgacccatcctttttccggactctgtgctgcagtccatcgggatctttttctgagcacaattaattgctaagattttggaaggccgaccaggcggtgcttcttggtgtgcgccgccgtcctggcccgcatcagccacacctatcaaaaggagcaggccccgagtcgtggctgtgtgccatcgatcggttccccccgaaccgtccatcagatacttcgccagccgctacgcaatcaccatgattcgtttacacatttgtagggacgagatttgtacttttgtggggttgaggcactaaagggttccttgccatccaggacgatgcagatcttggcaggagatgcgaatcattatcgggcaccttgaaatgctgatcggtttgaggattgagccgcattgcgcgtcctcgatccggctggtgatgatcaacccaccactgccaagatggccgctcgagactcaaacttcttgtcaaagcctctgccggtgcggctctgttgtctttggcagggatgcaaagtctagagctcgaggaggaatcgcaaacgtcctcatactcccctttcgtgatccttcaatgccaagaccagcaacagctggagccacgcgtgcgtttacgcagcctgtacgagtgcgacaacatagccaatttcagactacggcaaaattcgaatctgtcggttagccactagccgattcggatggggaaaatgtaaattacagagtgcactcggacccctgttgcccctcccgccaagccgttttacctggtgcttggcgtatttgccgcgagctgtaggggcccgcgctacgtaacgtcaaacgaggcgcctggcaagctctagaaattccaattcaagcgaggctaccctgtgccacagtagaatcagttcgtaaaccggttgcgatagatgcgaacatgttgagttgcacgaccaaacaacttaggctaccctcgagtcgtattcgcatgcttccacctacctgtcaagtacacgtacttgtttgggggctaaaaggcgtgcaacgtggtcttgtgtactgttcatttttttcccatttacatggatataatatctgcctaagaacgtgacgtaccaatcagcaatgccacaattattgtaccatcgatatcacaattgtcaatgatcagacgctccgagtccatgtggtagaattggtaatcctatacagtcgaacagtacaacccaaacgccaatatatagccaggttctatgatgtaagtcccgaaaactatcagccttgctataaaagcatctatgtaaatatggccttgccttttcctactcgtccttccccagatatctatcagcggcctccacatcccatgtgggcctttccaccagggcaatctcattcccttcaagtggaacgacgccgaatattggccgatacttgtaggtcaaccaccaggctttttgctgggcatcttgtgatgcgagatcaaggctccctgggccgacgccgttgccggcgctgtttccattgcggacttgcgtaagctccgcatcaaactcgtcatcatcactgttgctctcgtcaccacgctgaacgtcctccatctcgacgtcctcctcttgtccatccacgtgtttaagaattttgtgaggtatgaggttgctctgcagcatcttgccgccggcgccggtgcttgggccaactctcttccgtttcgtgcctgcggggacaactgaagtttccgaattctccgtcaccttgggcaagtccttgtctaaatcaagcattactaggaaggacacgccgtagatccaagctcgagaaccctgccacgtgacacccttgggtagatcgaggaggtcaagaacaggagcgggcagtgcacggcgggggtttcgtcgagaccaaggcgtcaaggtaccctcgagagggtggaagacaagtatgttccaagaccccgtgatagcaagaagtgagtaatcaccagagccatccctcacaccatcaacagtggcgggtacgtcttccgagaaggagagaactgccggcgcggatggaagtttagggaggagcctggcatttggattgcgtacccagcgaagtgaaagaccgtcaccagaactctcatccccgctcccctcggattcgctttcagaacccgaagcgctgtcatctgctgcctcgcccgtgccattttgcggattctctccttgggcaagcgaaacccaagtatcgacatacccagccagatctgccactgcgagcattttggaatccgcgctgaaagcaacgtttgtaatggtccgatcgtagcttccgaggcctccgttctggacgtagcgaggaatgtgacgaccaagtcgtctcaaatggccgatcttgtctgacgagaagatgaatttaccctcagtagcttgaatctcggccatagtgacccgatggccctcctgaacaaggcagacccaagagccatcgggcgatagctgaatttgcgatgcacccaatctcgtcaaactaccgggaagctcaatagagctcaattgtacatcggatggttttacaggattgttgtgttggagctggaaggccttgacgtcggtcgagctcgataccaccaagagagtaccgtcctcgttaatagaggcatcggaaatgttggagtccccctttacaacaattgttttcagtagttttcggttttgagaaatgtcactgccttctgaacccgaattgatgatatcattggctgattttcgaagaacccatacatggacctctcgctcccaccaactgataacgaatcgagctttgcgggcacttgcgatcgggggttgttgcggtaggttcgagataactcggtggttttcacgtcccatctctttcaagggcatcacaacgggattggcatcgggacctgcgttaaaagttagttagatgagtgtcaaaaaaagaccgacaatgagtgagtgggttcgacaaacctcctgaaaccacaacgctaagacgtccactctcgaaggtagccatgcacttgacatcatggttgtgatatcttctcccccaaaccttgctccaacgttgcccgttgggcttgtagagtactgttctcctatccatgccaccactcatgatggctgtcccatctgctgatgtcgccaagctcaaaatgtcttgcttgtggctctgaatacgctgcgtctgtgtgtatgtcttgccatcccaaatgcacagctggccggttgaatccccggacacaatgttaccccccgggagacactggacggaccagacaattatttccttggagccacctataagatcggaaccaagagtcatccgtcgcagcaagtggccctttgtaatgtcgtaggcgcgaatcgtgctatctgaacatcccacgataacgaccttgcgtgactggaaagcaatgctcaccatctgggcttttttagtcggagaccgaaccaccactctctggaagcggagatcgtcatcctcgatcgaatacataacaagttctccatcaatcgtgccggcgatgagcttgttcgaggtctggggttcttgcacggcccagttcggggttgctttgtcggagggacccgaaggctgggctgctatgcaccaaatgtcaccgtgctgaccgctggcatgccgcttcggctttcccttctcgaggtcccattctgtgactgtcgatgtgtagccgatgctgaagaggcgcgatttgcctactacgactcttccgtcgccaagatcttggtcggactcattgacccagactaaaccgtcgatgcttcgatctttgccgcctcgaatgatctgttcttggtgccaggctccgtttgaagggttccatatctcaatgtctccgtttgcgcgcccaatggcgagtcgcgcgagggcagtgtgcttggagcttctcgctttggggtgggagaaagcaatggcgttgatcgccgatggctggaacggcacgaaacgacagcgatgtacatccattttgacctagaaccaacttttctcagtctaaaagctcgagtcgttgctcaaggtagacagcgatactgagctggaggtggtcgctgcacttctaccttggctgcatgggggaatacagaaggtagacttttttttcttgcagcgctggatcaacttcccagattttttttttttggctggaccgctaccatgtttggttgccccagattgagcattggtctaggccaagagcggccagactatgccaaaagggtacatcctgctgcccctccaagggtccactacgctccaagtacctttacgctatttctgcgcccacgaggtactttactgccttcctgcaaagcagcaatgcatgcccctccctcctcgatgcgggtttaccttcgactatcatcggcgctgacgcagcctcgcactctaacattgactcattgtttactactagcatcggcattgcgctcaggtgattctgcgatctttcagaaacatctttgaatatatttgaaccaactccgcaccctgtgttttacacatctggctttccccaatagccgataggccgattataaatacttgggcggctccctcgccccgcgcgactaatactactaatcctgccatctctcttggtgttccgcgcattctcctcgaggccaagatctggagtgtccggaaacaaccatggatttcaacagctcatctcccttccccgagggggtaatctctttcttggacaccgatctgtataagttgactatgcagtgtgccgtgtacaaattctttcgtgacatccctgtgacatatgcctatacgaatcgcactccggacaagaagctttcgcgcgctgcttttaattggctcgatgagcagatccgaagtgagtttcctgcaatggtaacccgagatgcacagctgaccggtttgggcgaacagagcttggcaacatctccctgtcggacgaagaatacgacttccttaagtctacttgcgactacttaacccccgagtacctacagttcctgcgcgagttccgactacgaccccgagagcaagtcatagccacattcacaccagtcggtgccgatgacggatccgacaacgtcattggcgacaccgacatcaaaatccaaggcacctgggttgacaccatcctgtacgagatcccgatcctcgcgttgacctccgaagcctacttcaagtttatcgactcggactggagctacgaaggacaagaagagaaagccctggacaaggggatcaagctgttggaggccggctgcattacttcagaattcggcactcgaaggcgacgtgattaccacacgcaggctctcgtcttccgcggtctggtcaaagcatccaaggaggcagagaagcgaggcctgccaggaaagttgtccggaacaagtaatgtccatcttgccatgcgattcaacatcccacctgttggtacggtggcccacgagtggttcatgggaactgcagccattgttggcgattacagggctgccacagaagaggctctggctcgatgggttggctgctttggaaacaagctagccattgctctcacggacactttcggaacacaagacttcctcaaagccttcagccaaccggtccgagccgttgagggcgggctccctgccgagacattccagaacgccgacgggaccagcaagacgtatgcggaactgttcacaggtgttcgccaggactcgggggaccccgccgagtacatcaaggttctccgaaagtactatgacgagcagggcatcaagaccaagaaggtcatcgtcttttccgactcgctcaacattgatcgctgcctcgagtataagaaattgtccgagcagtacgacttccagcctacatttggtgtcggcacctacttgaccaacgactttacccgtctgaagacaggcgtcaagtccacgcccctgaacatcgtaataaagttgagttctgcgagcggaagacccgccatcaaaatcaggtgagctacacccaaggttgctgctgctgaaactctgtttccgctgcgaagctgctcctacattagcaataatctggttactgacatcttatttagtgataatgccggaaagaacaccggagacaaggagaccgtggagaaagtaaagagggagctcggctacatcgagcgcgaatggaaggatggtgacgagacatccagatggggcaaggatgccaaataaagtattcgagaagcaacattcgcgcagcggtttgaaacagagtatagattcatagatacctaccccaagggtaaagcgctggaaatacaatacgtcaattagcgaatcccacaacatttgccaaaaaaaaaaaaagaaaatcccaagcgaaagattccaagcacgtcgtcactctccataaacccccaatatacctgattctgtgaaactctctctgcgcccccgaaatccagaagcaacccccggatcgcggcgtcgttcaatgccgcataaaaagcacggcgaggattctgacttcctcttttaggaaaaggccatgaaaccggttcatgcggcgagatggttgcatatgtcatgcaaggcgcttgcttatattaataggcaagttggtgtatttagtcggggcgaatggcgtgcccatgccgcactcgcgcagccagccggtcacgagctgtgccgtcgaacacggacctcaccggcatttgctttttcaacgacaatgcttggggtgtcatccgtggcgaaaagcttttttattattatttgatttactggatacgagcagcggtgggtaataatatgatgatggtaatagtaggagatatatccgtgtatattagagacagaaaaaaatgaaatcctaagagataccaatagcctaaccgtttttatagaatcattaaagtccgtcaagtcatacagagagagaatacaaaaagtccctgtccgttccgttcttttccttcctagtaaattaaaaaaaaaagacaaaagagattaaaaagagaaagagtacatggtaattagaaattaatcaaaagcctctgggcgagaacggacccggcctctgggcaaagggcgagggctgcaccgcagcataggattcgtccatttccaccctcgacatgcaccagtcgaggagatatctgtgatcgtagtcggtggcatcgtacatggtcctgaccgccgcggacggccacccgcgggcccaccacattgtgttcaggtggcgatggcagatggcccagtgggcaacgagcgagagcgcgaaggggtctcgggcgtacatgaggtcgacgaagccgggcttgaccactcccagccagatgcagaaggcgtggtagttcctctttgggccgaacgcgagatgcagcgacttgaggagcttctgccctgcatgaattagcaccgccttgcggctgtcctcctgttcggaccttggccggatggattcggcggtgcgaagagtaacctgcagtgaggcctcgagctcctgccaggggaagtcgagagttacatttgcagcggccatttcgtgctgctggggataaggtccgtagatgcccatgcgaaagagagcagtggcgccctggtagagaccggagacctgggccagcagctcaatgcggtcatacccggtcctgtagtccgggtctgctgctggcagagtaaaagcacaggcgatgaagattgtgcatgctgtaagcagtgggttgccggattcgggggtcacccccgaattgagctccggccggtaaagctcgagggccaccgccttgtggtgcagggccgactcgagataatatccatgcgcaggcacggaaaccgcatggatagacgcaagatgaagggcagagaacgagaggagggcatggcgaacgtaggggtgggtgttggcgtagtagagaatggacgaattaatggactggaaatcgtctgggttgataatgggagccatgccagggactgccaggttggtgttatagtggaacatgaggaactgctcagtctggccctgggagctcaattgatgcgtcaaaggcggagaggttattggcaagggagcagtcgccaccgtgtgtgcactcgaattggtggaaacactggtgatgctggccggtgaccgggcagagctgccccctggtgccgaatggctgggcgaaggtcgcgttccatatgtagcgtatgcagatgtcggcgccgaggtggaggacatggtgccagtcgaggcagagacaaagtcgatgtgcctttgggtctgcagtgaggacccagacgagctctgagccggggttggggggaatgggttgtaggatgtcatgatgtggcgataaacacattccgtgcccttcttcaagcaacgagagcattgcggttggagctggtcgcactataattaggaattgaatgttagagaactctgtattttttgtaccttgccaaaataaagaggctgtctgcctttcttaccttgactttcttggccttgcactgcaagcagccgtggtgagagttggtgtgggatcgtcgagaaggcatgatgtataatataaaaggaggtggttttttctaagtcgttctacagacaagctggtaactagtttctgatttggtcgttttcttcttttccaactgatgctctttgctacatgatcctcctgtgctggatgtgatttcagacgcctgtgctggagtattttgagtggtggcgagtcttggctttgccatgttagctgatggccatgaccccatgagcaggtgtgctgtggatgagtgaatgggtgagttggaggaggaggtatgtgggtgtaagtcgggaggctctgtgtagattgatattcgctgcggtgatggtgttgaatatgtcatgtcaagaacgagccggctcaggtggtttgcttggggacggtgggctactgggagggatgctatggactttacatactgctctgacagcttgttatgcttggctgctgtcgtcttgaataggtaaatagagctggacccgaacggttggtgatggtggagaccgcacggttcaggcgagttggtatgtgcgctgaaggatgaggttctggcgatgggtaggcctgggctgccggatggttgaagctttgggattttggatcggccatgtacgagaaggtgaaaggaagatagcgacaggctcttgctattatatcaacctggactgtgcctcgcaaacgggaaagtcgaccatgatagcccctggatatcatccaccctgcctcatcacccaggccggcggcccgatgcgagagcagagcagcgcgaggcccaagcatcccaatctctggccggaaggggatagggcatggctccggatctcattaggagtgggaaaggatgtttctgtgcctctcgcgagcgcgggcacccatgcagctggccccatgaagcccatcgtgatgctgggccggttgctttgctgtcgctgagcggcccataattcgcggtggaatagctgtcgagattcgggggagagcgatggcgtatgctgacctggggttgcctgtttgggcgctggattggtcctgtcggcataaccgacactgcactaaaccggccaaaaaccgccacccgactgttgcactgtccacggcccagcaccaaagcagcctgatcaaatggttcctgcattgagagccccccgatctaatcttgggccagccctcccttcgatgcaggtacgcgcaccgaagatcagtcgaagcctggtggaaggaaaaataggggcgcggccacacaaccagcccggcggcagtccaatggcacagcttcccgcctggctccagcgcaccttgtcccccagcacatgctagctgctatgccgtaaggcgaggcagccaatttgtttccagcccccactcccgtgccagcctcgtctcacctcttccgggtgaagctgaagtcagtcattgccttgctcccagctctccccatcaccttgcttgggtcgcattctgcgtgcgacacgttcgtgggatggtcacatcagcaagctggagagcggcactgctgcgatcacgagcttccattcttccttccatccttccttggtggtccctctcatcggtcctcgtctgcatcagatccacagtccatcgtccatcaccctctaggtaggacacatcacaggaggcactcttgcactgcaacccaactggaggggcacctgcctatcgaacctgtgcatgtgggtgaaagatagccgggaagcaagggtggtgatgcccagagcaggcatgtgaggccatccatcaggatcagatatattgaacttccctcggccaggcaaagcgatgatgcatgcctagtgtagaaggtttctgtcagtgcttagggctgagacaaccaattggtgggtggtgtggacggcagatccaatccccagggtacgtatctaggataggtggaaaattgggaggggcagcacatgcataccgacctcagagacaccgacgtacatggctagtaacctgcctaatggtgaccgacatggaggcctgcatggtgatggtggactacaggatagctcggagcactgcaggcggaggagagctgccatcggcagtgggatacgggggtgagggggggggaaaggctccacacaccggctccgattccgagcgacctggtcgcagtgctaccccctacgtccgaaactcgttagggcaacgatttcctgtctgcgttggtttcacgacgaggatcacataatcacaccagaggcaccacaccgtagttccatgtaagtgaagctgtctcatgagcctgataccaatcgtcacattgcttgctcccccttttgcggagtggtgactggtgctaccatacaaaacaaggtatgatgatatcccatgattgtctctcacacgccatcacgttggaggaagccgcagatggtgtggtaaggatgaccgtggcttgcagataattcagtcatgggaggcaaacacatgaatgagaatagacaacgcaaagaggcagcagtacaggccagcagcctcggcagttgtcgtcaagtccaccgctaatcgctagcgccatagacgcagttaaattgcaaccgccgacagcttataacccctttgggcaaaatatccaattgggcgcgtcgccaagtgccaggaacggggatggctgctggtgatgttatagggtaccgaaatcccgctgtgggggagcatccactgtagggcggttgcactggcgccgctagttccccaaattattactaaccgcctcgacggaacatatgacacgcggcgacaccgcgattttgccaccttggagatgactgcatggttcgaagccaataggacaacctcgttaaagccgtaccggcgggtcgtcttgtctcgttatgaattaggctttgttttttgccatcgccgtattcgcgccattgccgaaacggtcgactcattgagtcctttttacatcaccggacaaggttcatctcatctgccttctcccaagctatggagcaataatgttatgtcgatgagcggcacattctctacaagcgtcgtatcacaattttagtccgtattcacgtcgacggcaggctcgggggcctccgtttatacttgttttggagtcaggatcgtatcattcctggcaatgagctgttgcagcggagcgaatgcgccttgcctgagaagcttggtgccgtcattgagtaacatcacaacagagatagagcagctcaacgtcctgcacgtcgcagctaccctggcacagactgctggtggggtagcatgagtctgtgcgttgcatgccaagggtacaccatctagaagctctggagaaggagcttcgatatctgcaactgaccgccaatgttgtcctacatgattcacaccatctcggcggtaaggcgcatatgacttgaccccagttcatagagaacccccgaaagcaccttcgaacctcacgtgagagcaggtagtatcgacatatacgactgcacatcgttatcatgaggattttgggtccatctatcttagagtaccatgcttttacgaagttgaactggtgttgtcatcacaccttctctttcagaccaatacgctctttgctaaaggccgatacttgcatttgtctgcgtcgtcatgcagcgttgatgacagcatacgtaggctcttttgaattcctctcgtgttgtatcacaccttctttttcagaataatgaatcccttatccttgtcaaccgtcaaggacaatcttcgatgctcgtagtcatctttggtaccacacggagccttacctgaagacatatactcggatcttgaaacaatagcagccgtagttgatttcagatcgtcgtctcacgagagatccaatctaatcacccttgtttggatgagaaccaatataatctcagaggaatgatatgccctgttgcggtagccggaaaggatcattttcaaattgataacccagccagctagttccccctaactaccgagaaaggggagagggtaggtaggacaagccatcccgccctggaccaattcagtcccgtccagcttgcccaacctagtctagcaagcacatacactagtttgctctccgttccttgtttgctaggggtcgatcagcactttgcgctagtcatagaaaaccctcttcaatttcggagctcgaatctgaacccagggaatagagctggttgcggactagcaggcgacgaaattgccggcgtcggtagactgtggtggtggtggtggtggtctgtgtgtagcagggctgtgacacggagagcgttgcccacgctccgaatgttcccagcatgttccgacccagggctggtgagccagcagtaccgatcgccggaacgggataatttgattgaaatcaacaagcgacgcgctttgacgaaccaactgccacgtactgcggaagccaagcaaaggcctgggccattgcggacctcctgggcctcgcttgggccagagtggcaaaaacacgctttcgcgacgtcatggaggcaggcaccggcgcgcctttccaacggcaccaagagctgtgccgtagaagcctggcgatgttaataaaacatcgcggattccagaaaaattttcatcgggctgatgacattcggtccacgaagtctccgtggaatcgaacggttgtgccaggtagggagccaggagccacgtctgattgacttgggcaatttaagccgctggtgacggtaaatgctgtggaaggtggtttcgcccaacctagggccagcgcctatagctctctcgggcgcttcccattttcgtcgtgagtcgttcaactgaacgtggacgggattgatgttgcgaagctggtcacgggacgagatgagctaagactgaagtccgcgacactcaagacaaaagtgggaccgggacatgcccattggcttgtgcctcaattcacttcaaatcatcgcgtttccgcactcaccggcgaaatagtacgtaaaatggtggcgagcggaaaaggggccgcagggcacctgtagcctctgctatgtttgatggggcacgctagaagctttttgcagctgtctccgagagaaaaaaaaaagaccaccactaaaaatccctaccgcatcggctactgctaggggtggtgggaagaaggcgacaaaataaactagacacttgcgcctttgagggggccggaaaattaatcaacaatgaatcagcgcccggcttcccagctgaatcagcgggcagcgatctagacagatgcagcgaacgacaatcgaagcatcgtgcactaggaaaagaaaagagaagcaatgaatgaatgaatggagaactgttggcatagcttgtaatcaagcttaattaatggggattcgaattgcaaattttttcccctagattttatgggcattgcgcataatgttaatatctcaatctcgttgaggctgaatgagaccatttaggaagggaatacctcagctggcgaggcgtttcaaccgaggaaatatggagacagccggtaacactgggaagggggtgcaggtgaggctacatgcaatgcgctgagcttactcagggcgtccttagtacctacatccattgacgtgttggagacgcgaacacccagtgtttgacaggcaacccgagtcagacggaccccgcactgacgaacaggcccaagtcggtaatgactcagtggcaaccgcaactccaacatcgatccatgaggggaatcccgaccactgcccgacacgactcacttctagcagcacatcgagtttgccgtgcactaaattgatcaatggcatgagtatggtgtccatggaggcgagaaatctaaatgtcgaaatatgaatgtgctgccaagaacaaaaggctggtggctacgtgtggtgccacagaagtgtgcggccatccttgcaactctcgataaaaaaatcttccatcttttcctcggttgcttggaacaagaactcctcatggccgaacccctttcctctcactatcgtaccactttatacattttgcatagccgtgtcctcggccctcgccatcggccgggtgcgacctctcggagatatgccacgctgtgttggggttggggtagggagggggaaagggcagctgggaaggcactggcacttacatgctgtgtcaccttgtgtgccgcatgcaacggtaaccacggctgccgttgggggagcgatgtgtcaatgccagcagacaaatgccgcggtggcagaagactgcgacgctaccccaaggaagttatacccgtgatcagccaatgcgaccacggaattgcgacaaacgggctcggatggtgcgggcaaagcggccagagcgggtttcttgctgcttcgttaccccaatattggcgaccctggcttactcaaaatacctcgagattgtatgtaatagtaataatgggaaatccctggttggctgctccctgctcatgctacctctacgcgtttccacaaatctagattttgtcagggttttgacgtccgttcgcccgagaacgagggagtggatacagatgtgaagtatggtggtgaaggaggcgtaaatcccatccgaggcatccacgtacagaggttgaccatgagtcctctgtctgctggtgagaggacggtagtcgcggagcaatgagcgcggacagccttcagagcagcgcggaattgtgacttggcagcaagatgtaatagcttgggctagcacacgaatttcttggtcggacctagcgtatgtaaaaagaagtacagacaaggtatgcacatccactgtgggtttgcatcgaagatggatcagaattttggcgacgtctgtgatgcaccccaatgattcagcttttttgtgactgcccgatgtagattcggccttcggcacaggttcgatgcagcaaagtgtggtgtcaggaggccacgctttagcggaccccaacgaagacccttggcgctaaaagtacggccagtggcctgctagcatgtctctaggctgccttttccgcccacagaggcatcttcggccgtcttctcctcactaatgaggtaatggattgcgggaggtgacgttggagcgcggcttaattgggatggaccttcatgttcctggcctcaattgactctcagcaagcggcatctcgcacaatcgcacatcattggggggcggaaaacacacataaccgaaacggaccgaaatagtggtgttcaccgccgtgtgtgtaggtagcattaccccaagatgctgagcaacgggtggtggtagggattgccaaggctgctggcataattataccccccaccacgaggcgcaatgagagggtgacaaaaaagaagggccggtggtggacagcaaaggataccccccgcaagcctctcaacaagcgtaatcccaaattgtggtgccgtcaccagagctgtccagtcctgcataatttcacgagcaggaaactgggctagcctgacagctgtcaacgcatgatcaagggggacaatagggcaggcgctgcatgatggaggcttctagtctcttgcgtagaatacggaactggggaaatctgagtgaacggtgggcgcagttgcggggattgaggggtgaacaatgcatgaagggggaagggaagtaataatggacggtgatatcctgctttcggctgtcatggatcatcaagatcatcttagagaggccggatttcgcccaaactccgtccacccccatctgtactctccacggggcccctctgaagccccatcacgcaaagccctctcatctctgttctttgcccacctctataaacagcccttccccagatctcctcatttctcctcccccttagtctttctcttccctaaacaccgtctctactgtccattgccagccgagcagccagtcctcaaccaacagcccaagtgatcacactttacaactgttctcttgaagtttgtcaagcaagcccaagctcccacctggagccagactcgcgtcgagcccgcactcagtacaacttcaacctttagcggatacccgaatacaatatcacaatggcatccgagacccatcacgagaaggtccaccctatccagcctgtccacactgcttcctcaatgaaccctcaacaaggccctgaagaggccctataccttcccaatggcaacttgttcctctccaatggtatggccgtggcctcaggtggtcgccttcagcctggtctgtggagacctcttgagcaccgcaagtttgccaacccggcacctcttggcctgagcgcgttcgccttgacgaccttcgtcctttcttgcatcaatatggaggcccgtggtgtcaccgtccctgccgttgtcgttcctctggctttcggctatggcggactcgtccagctcctggctggcatgtggtatgtcttcatcgttcgttccagcgaatgaactgaccgagaataatttatgctgacgttctttgcctgtagggagatggctgtcggcaatacattcggtgctactgcactgtcatcatatggcggtttctggatcgcctatggtctcctccagacacccacctggggcatcacacaagcggatggtccctacaatggggagacggccaaccccgtcggcttcttcctgaccggctggttcatcttcaccaccatcatgctcctctgcacccttcgatccaccgtcgccttcttctccctcttcttcttccttgatctggccttcctctgcctctccgtcgagaactacgcccatgacctcggcaacgccgaggctgcgctcgccctgaagaaggctggcggtttctttggattcctcgctgccttcctcgcttggtacaatgccttggccggtatccaggacagcaggttagttcatccgtgtctcttctccctcccaccgctcgatgctgactttttacaatagcaactccttcttcaccgtccctgttatccacttcccttggtccgacaagggcaagcagcttcgcggcaagaagactcagcacacagcttaaacgaacaagcagacgagagaatgaaaacagacattttgcattggaggtagtttggaaaagggaaaacattgaaattgatatgcttaaggggaagccaagacttattgatatggcataggctttcctcctttcttgcacatactgaaatataattttgggacaaaagcggatatatcacgaattaaggacaatatttcatcattattccctagtgacggcaggctcgattcctgtgggatcgaggtaatttacattcatggaaaatcggatgtgttgagatatggtttttgggtttgaaataaggtggaacttgtctcggcctggtggcgacgagtcagtaaaatggtggatgggagaatgaaacttgggcatttcttaccccccacaagaggcacgtagatacacaaccggaacaacaagacgaacacaagcacttagactttttgggagctatcatgacgctccttgcagatgcttgttgccaagaatggaaatggcggcaagaatctcatcgaggttacatcccccgttattcccggcttggcttggcaatagtgtccagcaaaaggcgtggaaaaaaaatccggggatgggaatgtccaaagtggggaggtgaaaggagagccgccccgacgtcggttgtcggttgttccccctcttccagctggggacgatgtggttttggtttcctcaaattctcttcaatgggacggaaccagttgcgacacgctccgttgctcactctcacggatacggacggctcagccaggttggatcggagttgagatcgggcctgagatcggagcattcaagcagcggggaggggcctcggaaaagttcaacagctgctcagggagttctgttctttcatccatgctgaacgccagttctcctgggttgaacgtgtacggatcgacatcatgaaggccgatgtcaaggaagttgagatgggcacagatggctcgaaccacatccgagtctcgaacaaacaagacaaccaagttgctgcgccagacaataccacaaacgtgccggccaatcccccaccgcctccgaatggcggctacgggtgggtttgcacagcgtgtgtcgcgaccatcaacggtcactcatggggtctgaactcgtcctacggcgtgttcctcgcctactatctagccaacgatgtctatcctggagcgacctccctcgagtacgcctttgtagggtctttgagcttcagctgtgcgcttctcatctccccactcgccactatcggcgtccgccggttcggtaccaaaccaaccatcttgctcggtgttgtcctcgagtcagccagtctcatagcagcgagcttcgccacccggatctggcacctcttccttacccagggcatcctcttcggtctgggcatgggcttcatgtttgtcgcatctgtgcccattgtgccccaatggttcacgacccgccgctcgctggctaacggcttcgcgacctgcggctccggcctcggtggccttgtgtactcattcgctacaggtgccatgatagagcggctaggattagcctgggcgtttcggatcctcggcatcgtcgcattcgttgccaacaccatctgcgcgatcctcatcaaagatcggaataagatcattggttcgacccatctcgccttcgacatctccctattcaagcggcccgagtacctgctcatgaccgcgtggggctggttcagcatgctggcctatgtcgttctgatcttcagtctggcaaactatgccaacgaaattggcctgggttcatccgaggcggcgttgataagcgcagtcttcaacctcggccaggcggttgggcggcccttgattgggtatttcagcgatcgcaccggccgcatcacaatggcagccctcatgaccttctttgctgccgtcatgtcactggccgtctggatccctgccaccttgtacggggtgttgatattctactcgctcgtggggggcgccgtggccggcacgttctgggtcacgatcggtccggtgacggcggaggtggtcggtctgaagcacgtagcctcggggctgaacatcatgtggctgacgattgtgctgccgtgcacgttcagcgagcccatcgccctgaagattgtcgacaacacgggcagctatctcggcacgcagctcctcgtcggcatcatgttcatcgccggggctctctgcctgttcgtgctgcgcgggtggaagattgccgaggtcaacgagattgctcgcatgacgaaccaggcaccagaggagtttgatcgggtgaagattgacaataatgaagagctcgtgcattcggcgcgagttgttgcgaggaaggggatgctcctcgaggtatggaggctaggcaaggtttgaaacttggccaagcagacctcctgtctgacccctcgtatctgatataaatactgtaacataaaagcaatctcttagttttatagaagcaaaaaaatggaagatttagatagctctcaaaaatttcagcatagtatgccacttggtttcgccattgcaagaattggccaatggatggatgcgagtgcccacctgtggataggaaccatcatctagtgctgcatctattgttacatcaagtgtcgaactgtgttatggataccagggctgcattaagcccacgttctcgtgtgggtttggggaatgaagatgatgcagtcgtattctcaaacatctagacgcagggaccatataacagtcaacgttgttaggctcccgggatctatatttgtgcccattcctgcatgagcatacggacccatccctaaattgtgagattatgcagtgctgggatctgttgttggttctgcttcttctgtcacgcatggagagggtttgatgtcatgtagaatattgaaatttttttcttgatttttgttcatgtagaagtatgtatgtaagaaaatagaaatatacgtttgtagcaacgaccatgcgaaactgagtcacatcaaattatcctgtacgcctaatatctcgacaccagtcccgtaaatcccagtctaagaactggcgaaattgcacatattatctcttacatacggccgtcgtagtacatgtaggagaggtagggccagcccaggacgaaagccatgccggggaagaagctgtggaaagaggaaactcggtcagcccattttcatgataaaatgcatcaggtgatttacgcccagacatggggtgatgttcaagtgccaaaagaggggtgaggggggcaaggaagacgggaccggagtggagagagaagatccctcggggcggagcttacatcacagcttgtgaaccaacacggcgaaactgccttccccagtcggcgggagcagacttggctgtaggcagacgctcaaagggatgggcctccattgagcggccaacctggcgaagagatcggatgatagagaattgacggcgacccatggtgcgcaccacttgagcagtaacgggagacatgattatggagagtggttgtttgttgttcgtgagaaaagtcgtaagaggagggatattatccttggcgaggatagacaagaagattgagtggcgtggaagaggattgaggggagttgagtcaaccgcgaggtttgatctagttgtttggatcgtatatgttcctttgatgatgggagagaacaaccaggaaggaggacacaggtcctcgtggttattatactctggacgaacagccgcccatgcccaagaaaggctcttacatggatacgtatatcccaaaatcgccgttgcatcctcaagatcccgactcctttcgtacggcggagtcgttaggcgaggatgaattggtaaaggatggtcctctgatcccagatatcacgccacgtctgacgcagaggcatggattctggtagccggccacacggcgacctccagctttcgagcctcatggtacgatgcaaaccgcaggcggccggcgccgggggccctggtacgtccttcgaacccgcatggcctgacagcgaggagaagcccgggattaaccaattgttaccagttcaagggtcagcagaaacagggcgccgggtgggggtggggtggattggccaatcagcggcgctgcctgctttacccgcagcatcgaacgattctgaagggtgttctcgggcttttgtgactggttgagcgagatggccagtcttgtgagctgaagaaatctgctactgggcgaagaaaagcatatcgggacggcggaaagatctaggcgaatctcattgtacgtaggattattctcgattcaacgatcggccatcgttacgtgcgatgcggcgacccggacctagcgatatcaccagatttaccaggcacgaagcacaaggaagttagatccaagcagctgacataatgtgtgagttttgtttcatgtagcttgctcaagcccttctctatgacggccaaaaagggtggtgattttcagcagagagagaagtgccagctccaaagcaggataaacaaaaatacaagtatccagattgtacaaccagtgagcgtttgtttgcaggtgggttcttggtgagaacattggatgaaaggcgtagggctgctggtacgtacagtgacagcgggataggatgcaacctggaagcacgtgagctggcgtttgtcaaacgcgccgggtcgccccgctggaaaaggatccacgcgctggacgttggcttaggcgccttgttcccacgtcatcgcaacggcgagtcgcacgacaaagctaagctacggcagcggacagtggattgccatagcacggtacgacctatgagtccgagatctcagtaatgtggctcttgcagagcgatgaggccttcgacggcatgtgaaacccacctcctcaggagacatcccattgacgttatatgactgacaccctattgattcctcaggccgaaagctgtggttgagacctggcaaaacgtatctcttcgggcgaacggtgtcggaaggtaggtgcctaaactagcccgtacgatggttgcatatatcctctgactgttcttactgcgacagccggccagcttgcgatttcacataacacgatatctcgtaagcaccttaccatcaccgtcgacaatgtccagcctgggcatgcatacaacctctctagccggtctggagttacgattgaagacctgaagaccaagataggaacagtggtcaatggccggaagataaagggtgaccgatatgttgttgatggcgacgaggctgagatcaccatgggcaagtgtccaagcaaatttgtgtaagcaaaagtatgctttgcgctacctaccaattgtttctgacctttctagattatcttggaatcccgtaatattcacattctccttcacgaagaaggaattgcagactcagccactcacaacactccaagatcggttcgagaaccttgacatcaagcttttgaccgaatacagcgccaagtacaccacccacgtcgtctccaagaagcgaaacactgcaaaaggtctccaggctctaataaatggaaaatacatcgtcactgagaccttcctcgacgccgtagtggaagctgccgcggctccggtcggggatggctcggaaaacagtgcgctcgaacaggattatgaggcgagctggcctgacccaataaaacatcttccaccacgcggtggagagcctgtacagcatccagacgagacttatagccctgatcctgaacggcaggaagtttttgaaggatacacgtttatcttttacgacaaggcacagtatgacaatcttctggctccgatcaccaatggcggtgggaaagccttcatggaaattgttgagggaggggagacagaggtggacgatttcgtcaatcgtgtcaaggcaatcgctggtgaacaggccctcggagacggaggaaagggggcagtccttgttagattcgtcccggcgaaaggagaacaaataccatggtacacggacttctttactgctgtctctctacgcttggatcatcgtccaatcgaacagagtgaattccttgaggcaattttgatcaaggatgccagcattctacgtcgacctctagaagttgacgattcagtaaccacccagccccctcagcctgacgcaaatacacgacaagaacctgtccggagtggtgcaaattctgcatcgcaagatgaacctcaggtcatacaagaatcgagatccgctccccgcagaggccgtactcgaactgctgtgaagcggcggtttgcagggtttgataacgactcggatattgatatggatgatacgccgtcagtgccccccaccgagagcaatgcaaccccacagcaagaggagcaaggcttgttcatgtctcaagaacccgaggcatcacaggagccttcagggccttcccggggcagcaggtcacaaagaaaaagatcgcctccgcatgcggatgacgatatgggtgacatagcacctgctgcggtcagatttaaacgccaacggttagaggcaggcgatcattttgcttcgccgtcaccggagccagagccggaacctgagcctgttaagccaccaaaaaagattaaaaaagagctcgacgtacttgctgtagctgcgcaaaatcgagaacaggaggaggccagagctcgagcagagaaggaagacctggcacatctccctgatgatatcgatttatcgcaaatccgcaagctccaaatcgttgagaagatggatataagagatccttcgtctgctgtacggagccaggaactagatattgccggtggacggtggaatcccaagtggaacggcatgaagaatttcaaaaagtttcgtcgccgtggcgaggtcactggaagggcaccggcaagggtcatcatctcgctggccgaagtcaggaataaggagtttggaattggcgatgactattggctggaaaatgaaacccagcggaagaagaccaacagccagccgtcgggcaccgagtcacaaccatccgcaccccgggtggaggctccggcacctcgagcaccgcggatcatgatgtctgatagcgaagatgaggctccggaaccaactgacaacagcagcgcctcccaaagacgaacaagaacgacccagcgcgagtcggggttggctagccagtcttcacgggccaccacgcagagccagggcaagcggccggccccggagcctccaaaggcacaaccggcgaagagaccgcgacagacacggaaggtcattgagattgctgatagtgacagtgacgatgatctcaaattcagatttggtaagagacggtagtaggaggcctgtctctcagtacatagggtatcttttctatctagatgaaaaggaattctcggtggcatttcgcccaacgtatcctctattcgtacacctacctcatccatacaaacgtttgattatggatcagtccatttgttccatctcactcacatactcggtaccttccggctcgtccaccagaaggcccacaagacaggcagagagcatcgtatcataatttacccatgggtgaacctctccaaatagcttggttgcgtccttgcccgcccccctcagtagttcaggtatcccgccaggatggtattcggcatagggtgtaatattatacactttaccattcagacccatccacgcgtccttgccctttcgccccgtttgattcttcagcatcgagggtgttacgcgtaggtatggagtggaggagggcacgccgcgtagatccgagctgggcccagatatccgcgcccagtcgagaggagagtgaccaggcgtcaggaccaccttccggctgggctttgtagggatggatgagtgtgtcgggggaggggcaagcccggaggaggagggaccgcggtttggagttgggccacgggcgcgctgggcggagttggcggctgggaactgtgcgagacgtggcgggtttgccggacgaggaggtggtggcatcaacgatggagttgagccctgcgacggcgcagaaaaggaagatgccggcacggtatcagagtattcatcgtcgcctatagagaagctaggcactggctgtgaaggtatcgcgggcgatgccttgggcgtcgtttgctcctcgccagattggtcagcattggagggactctgggaactggacgctggcgaggctatcgacgctaatggcggcaaggagcctttgccagtagcctcccgagcagctgacggggtgtcctccgaggagatggctccggtatgttccccccggtgtgtcccgggagaatcatcagatcgagcctcgcggcgtcccgatgaagggtcagccccgatgctgcctctgaggaaggctctccattgcaagagccatgggggcaaccaacccggtggtcggaaaaatacccaaacaacagaggcgacgataagcgagatccccacggctaccatcgtctgcggacgtcatacgatggtgggatggtttgcgggatcgagaggggcgttgaagatttcacacccatgttctgttctctcggaatggagacatgcaagggggggggaagtttgagttgtaggaggcttcgctcgcggtccctataatttgtcgtgcagggccagagttccccacagggcctgccgtgagatatgcggagttcgtactggaggttgtacaagtaccacgcggcattactaatttatgcagaggccgctcgttcttgtacacgtgccattaagcagaaggtccctggacgctgagtcccgggtcctaaaatagcgccccaggtgacctacgctcttgccccaaacaggcgatctggtctggccggcaggcagctaccttattatggaggcactgtgattctgtggaggagagggcctagacaaagcagggaaatagtgcagaccggccccgagtaatgtcagcacagctgcccgaccttcacgtcgagtgaatgccaggctgcaagggcattcggtcccacgcctagggggaattcctccgatgtttgtttagctatccgagccaaaatcgatctctcgacaatgcgcattgcttgctttcatgccgtgaaatacccaattcccttagcctgtgaaagcctccctcactcccggagcggccgctaatttctgaccttgacgcccaaggccgggtcactacaaatcgaggggccgtggcacgacagtgacgcacctccactaggtcaccgccctctggcactgctccaggtcgaaaaagtttatgatgcgatctctcaataccgcaaacacaacacagccgaaacatcccgacgaatcgacgcgccccaacaaccccaaggctgtgcgtagcttcagctctcccagctccggccagacattgggcagcgacacaaacgtcaaattagcaaatctacggccgccgacgatctacaccacacctccatcctccaatcccgcccagctgccgctgccccgtgcccgcccaccgctacgtctccgcaaccaaagccagcaaaatgccccatcgctgaaaccacggcagactaccaccaccatcacaacaacaacaaccacgaggacgcgtccgggaatcaggactgtgtccgctcccacaatgcccccaggcagcgacaacagcaatagaccccgtcatcctcacctgagtgctactgcagccaaagccctcacccgaccgccccttacccccaagatcgcagccaagacatcaccgcatctcgggtcgacgccactgtcgagaaggtctctcaacgcagggtcgacaacaccgtccatttccaacacccacaatgaagatgcctcgtcgtcccctgggctggcgtcccatctgcctgcaattacgccacgaatagccaataggccgagcacgtactcgacaacaacaacccacacaccgatgttgagaaaggaatccgatacaagtgacggaagtagttcgaggcagaactctcaacaagactctcgagattccaagttcttcttcgccagcgaggtcaaaccaggagctcagcaaccccctcccccacaacctcaggtgcagcaacggcccgttaccttctactacgccaatggatcccaagcggagagcaggaagtcgagcagcccctcgagcacctcgtccttcaatccagcgcaggcctcaactcccgaacccacgagcaggaaattcttccatgctaatggagccccggatcatcttcacgcaacgcaggcacccctccacagccctcgagctacaccgtctcggccaggaaccgccagttccggtgttagtcaaggaccagcaccctctcagcgaccaatgtcacctgcaaaagccgctacaacgccgatatctgcacctttacatcagaccaaccctaccccggcaagtgtcacaaatcggccaatatcctcgtcaccgtcaagcttgcttccggcacatattcctcagggagggaggcgggtcagtatcgagtcgccaaagagaccgcaaagaggccatgccaggactggtagcgttccggtattcgactatctggcagctcagaaacaagctcaatccccaacgagtgcgcccagttcaccgccacaaagcccagcttgccagccggctatgacgatggcgtcaatactgcaggcggtcgaggacatgaaatccgacagcggcagggacgacgactcccttggtgagcttcaaagccccaccaagtcaagccacggtgatattgtcagtgacctcgttgccaatgcgaggcgagaacgcaaggttcaggaccttgagataaccaatgcatctctcgaggctatcaatagaacattggagcgccaattaaggaggcagactgccgagctacgacgaattcgtcgaatgtcccgatcgggcaaaatgatgtccgcagcctcaagccgcgtcccatctgcggctctgcctgaggtgcctgtcgacttctcagatcccagcggcgaagaaagccaggctgaagaagagcctgagtcgatacatgaatccgagttttctagtgacgaaggctcagcagatgaggccttgtcgcctaatgccaagatggccagcagacgaaagcaggaggaaatcaggctcaagctagaccttaccaagcatcaagagctacttgtcgacagccagaagatcaaccagagcatcaagcgctgtttagactggactgaggggttgattaaggagggacagaaagcattggaatacaaagtcagggtttcagatatcaaattcggtggccatatcctcgcacctcccgacgacgacgaagaggagagagggagtgccattcaggaatatgatgctgacgaacaattgtccttggaaaatcttgaaccatggagcgcagcatcctcaaaggatcgcgatagtggcattgagctgcccagtgacaagggcttgtcttgactcactgacagatgcaacgtcagtccgtgagcgcactcgcctcttttggagcaaagacataaacgaatatcaacaacaacattcagacatctcactcagacaaaacatcatgcgaaattacgcgacctaggtgtcgccggcgaatattggcggcttcctgttaatttgttctttgcatcacaaagcgattctctcacctctgacgactcaatttttctttgttatacgccatcggcaagcgaaggcgttttatgcgactgtgttcatcatctcttcgtttcatacacgataaagtttccataattgctttctcattgctagagcgaccaaggctcgaagcctttcttcttcatctcttcttctcttctctcacttcccttcctctcgcttcttctcatttttttttacatctatttgattttggttttctttaatttactgcggtcacgtctcccttccttttgtggattacatcaattgtacaacagatacccccttgtgttgagattagccgttgcattaggataagccggcaccgatttttatgagtgaaccgggcggaaaaacaggaaggagattaccgcatggcagcctcggagggctaccgatatagaaggctaaggcgtgctatttgaaaaaagaggctggcttcagctcacagacttgagggggggaataactacaacaacaaccacatctaggaataaaaggcctcgctgagaggcgataggatagaaagtaaaacaaagcacccctgggtgaagacccgattgaagacttgaaacagaaaccagacatcacgtgtccgatatattcctctaatacattaagagccaggccagccaaatgttcaattattgacaaaagtttggtggactttctctgatgtcgtaactagtcataaatggatataaccaaaaaggggggagaataaaaaaaaaaagaggcaaaaaaagggaagacatagtctaatgcgtaataaaacgtgctcgtcggggtctaaaggagcccattgtatcctagacctgtgctcgcaaaccactcgcttctcgccctaacccagacagacattcgctctattcaatacgacgcatcccaccctccttcacagttcatgggtaaagctcgagcttcctttcttttaggggtatgaatctaaacggacgaggtggcggccgcagaggcagagtttgaagaagcagcggcggcggcggagtatccgtccttcttgtccttcttcctcttcttctcctcgttcttgtctttcttgattgccgcctcggcgacaagctgctcgaagatgagatagtcgccctcctcctcaggtgagcgtgcggcctgtatgaacattagtaacctagagatcaaaaagggagccattagaaagaaaaggaggtctcctaccttgttgaagatgtcaccaatcaagactagggcctgcgcacgctccaggcgtttgttgagcggaaccttcttgtcgttgagcacaacgtcgcacacttcccgtaggacgccctggatctcgaacttgctcccccgccaggcagctgtgagaatcttgccggtgacacggcgctcgtactcggccctcttctcgtcgttccagtcctcgccgccctgctcctccatgcgggccatctgctccatggtttgctgagcgtcaatagcgctagtaatggtgttccacgtttcctttaccatgttgcccttgtcgcggagtttgctgaagaagcctccgatacccaggaatttctggctgcggagcagggtagaagcttttgagacataggtctgtccaatcgcatggaggatgtcaattccaaaggactccatcttgagattctcaacctcgaggcgcgtcttctcctggaaggccctggtcacatcggcgctcttgtcagtctcagtccagacgctgagacggtcgatgagctttcgtacaagggtatcgacacgctcctgtcgaatcctggcgcgctccttctcgtaagctgccagctgctcgcgctgctccttggtgagaccagccttcttcttctggttggggtcctctggatcggcctccgctgatgcttggaggtcctcgtgagacttgtcggtcagggctggtcttaacgggatctgggtgcttcgaggggtgtgggtgccgggtgtagatgaggcggacggggcgggtgaagccgcatcatatcgtgggggggcggcgctgtctttcttcgtctcggactcgtccacgactaccgtgggcgggggggccgctgtggtggttgtgccagcctgagccttctcatcagacttcagactctccttaatagcctcttcggtgccggggaactccgcctcgcccttgatattttcctttgcggcgtcaccatctaacttctgttcctcctcttgcatggcgatatccatggttgcggtaagatccttcatgaggctgatctcgccaatccagtcgacaaacgcttcgccaccgaagatattgctgaaaaactcggccgggtcggcgaaaccctcctggggtttggcatgatcctttccatacttgtcgtacgccgcgcggaggtctttatcggacaggacttggtatgcctcgccgatggactggaacttctcgtgcgcagtggggtcgttggggttcttgtctatgcaacgcaggttagaccagatgtatattcaccgagggctatcgagcgctgtcgaaaggcagctctcgttgcaggtatggacgcacctgggtggtggatgatggcgagttttcgataagccttcttgatctcgagctctgtcgccgtgggctggacacccaaggtgtcgtaataggcggtgtcaacaaccatcttgagcccgctttggtttcctgcggtcgcctttgtcctttgtaaatataggtagcgatactttctagatgtacaataccaaatggtaggtgtaacggtagttgggaggcaagatggccgatgccaaggcaaagaaatgatcgtcagcagcgattttctgcctggggcgtcagtgtggcttgaaatttcgcaggcgctacgtaatatggaggggcacaggtgaaatggatgcgccaaagccgtccaactaccagtggaggccactacgtatgttgcttcggcgctcgctgatgtggccttggctggctgccaggtgctaggctcctcatccaccgtgtccagaaggctgcaactgcctccagtccagaacggatgggaattactaaggactggcgttctcttttgccatttatagcatatgcgacacttgcctgccccccgtcgtcatcgatcattactgccactgacaagttaatgcggaacagacttcgatgtcgggtccgaaagccaaaaccctgaagcactaccaacaggaatcgttggtttatcccatgcacacgtacctcgcatcaacccggttgagagaggggggggctctccggttcttcccttacattgatttgtagctgcttctgtccgtccttaagcgaggtaggacaaaataaattgaatattagcctagatgtcaatattcaagtccgctccggagtagctagccgggtgagcgacgcgaacagagaccacatcaaggcaaacgacgaatgttggctggagaaacaacaagcacagcaaggaaatgaaatatcaagatacatttatctttttttccccaatggtatcaattccactgctaaccaaagcgtactgcatccatcaatcacatatcggagactgagagggtgtcagctacagggtattgaaattctctgaggacctgtccccagttatttcacttggtatgtaagcagtgatggttacaagcgccgtgccggatgtagttggccaccaagacaacgaacgggataggatggtaaagtgacggattgcatcctgatgacctggtcaccgacttttgcatggttggatgcgtttcatgcacatgcaagagcgctgtgaaggaggctgagtttgacaccacgcgcagatggggatttctaatttcgtattcgtatcgggggtatcgaactctgctagcctcttctattatacgccgctaggtatattcctagttgcttcaacgggtatgcgtcttcttatttggtagtggatctcgattatacctgtccaggtttgttgcaaccattgggccgtcggaggagttaatcttaacgaagccagccattggtttcagtagccatacgaaaacgaccgtggttgtctcgctagtcggaagaaggaagcatcatcgtggaaagagatcacggctaagtaggtatctaccggagatacaccttcagattgctacatggacagcggcacttgctgggctggggttcgggatggctgcatcacctgctccccaatgtgggttggcaacctcagcactatcttgtggatacacaaccggggtttacagattccgatgctggtatttccagtgttggcgagggaattacaatgtttggccatgtatttggctgctggtcaagatatgcaagagcgcgaccccggtgatcttgtgtgatagtgcgaagtggaagtgaggtccgcctagccgtgccgttgcataaggtagtggctgctcgtccgtgagagctgcctacgtaagcgggcaacggatggctgcttgccgccaacatcaatataaccaaggttgcatccataatgtataaagacgtaggtggtggtggccagccagaagcaagccggaattcagttgagaggtccagcgctctccacttgggcgaggagagaggggaaagggggggcacttttctcaattgaacacctaggcgggtactggctggtactctaccgatcctcgggctcctgccgagttcaacctgtgcgggagcaagaggcaagtacctccaagtatttgccagttaaactctttctacaggtatccccaccacctgctgcaggcccccgccgacccctgtcgtttacgcagcgccaaattactacaaaactgaagcctgtgctcgaccagtgtgcaattttgccttccctcccacccccagcatttgagagtcgcatacttttctcccaacgactccgtcaccaaagtctgactggagccacggaactcggtgcgtttcctcatctgcgttgggctccggtctcaattgataccagtgcgatatatatttggaaccgccggtccgtctaggggtgtcgcaagttcatcctccgccgcagtccttcacaatcctgcctgttgagcttagcctagcactcttgagaccgtccctgcgcggtcgaaatctgcacaatgggctacctctacttcctcctgcacccatcggagttgcggtcaatcatacaatggtacaccttgtggcccagtcccgcattcccagaatagttctgactcgaggtacaggaaagtctaccatgagcctcctcaccgacgagacgagtccaaggagggtccagagttgaaagaatgcttccgacttctcaagttgacgagccgtagctttgctgccgtcatccaagagcttaaccccgaactcctcgtccccatcacactgttctacctcgttctccgcgggctcgataccattgaagatgatatgacccttcccctcgagaagaaggtccccatcttgcgaaatttccacaatactatcgatgaagatggctggcaattccacgagagtaaagagaaggacgcggagctgcttgagaagttcgacgtcgtcatctctgagctgaagaagatcaagaagccccattacgatatcatcaaagacatgacattgaaaatgggcaacgggatggccgactatgttgagaacgatgagcaaatcaagaatggcctccagacagtcgaggagtacgaattatactgccactacgtcgccggtctagtaggagaaggcttgacacgcctgttcctggcctctgaactggcacaccccaaactggccgagaggccagccctgaccgagtccatgggccaattcctgcaaaaaaccaacatcatccgtgacattcacgaggattgggaggacggcagacgatggtaccccaaggaaatctggagcaagcacattgacaagtgggaagacatgtttgaccccaagcaacgtgacaaggccttgaacgtcatttcggagatggttctggatgcgctgaagcatgccgaggactgcctcttctacatggcgggcatgaaggaccagagcgttttcaatttcgtcgccattccccagggcatggccatcgccaccctggcaactgtcttccgcaaccctgatgttttggagaggaacgtcaagatcacgaaggggtccgcctgccaaatcatgctcgagtctacacagaacctgttcgtcgagtgcgaagtgttcaggaagttcgcccgagagattcacaacaagaacgaccccaacgaccctaatttcctagccattgcgacacaatgcgccaaggtcaggactattcttacctcttgtatttgccgtgcattcgctaacataacctgccctgattagattgagcaattcattgagacgctgtatccaaggcaaaaccctgataagctgaacgcatcaaataaattaaagcaggctggccaacaaacggccgaccctggcgagactgtcgtcatgattgtcgtggctcttcttgcaatggtcttcatgacccttcttatggtgcgtctcacccccttcctctgctcctcggcagtcgcttacaaggtgtagattggcactgcctggttcttcggcgcccagtttggcaacatgttcgaagacatgaatttccttaacccaagcggctggctcaaatcatcggctgatgccggtgctcacgaagaactgtaatgatgatttagcgggattttggtttttttcatcttcatgtttatacgatcttcgctggcgccgcaaatgtataaggcgactttatcaggtctcccctgaagttattaatacaagcccaatatgaataagtctggtatgccgccgagcagccagcgcatcaccctcccctggtttgtgttccatcgaaccgtccccttgtcctctcccgaagcttggttttctctcgttagcacggatgtcaaattgcaatctggtcctttcatgaccatggttgtgccgaagaagtgcttatatcaacttaaccgttgctcctggtcttgccatccggcaagacatggtgttgtgtcctctcgcgctatgaatgagtggacgttaatactagagggcgaacatgccatcacctactgtgaccaagcaagtatggttgtagagtgaactataatacgtcatctttattagaatatgcagtacgttgaaacttgtaaaaatacattgaccgttgctattttcggtaataatctattcattgttctttgccattgtctctgtgccctctcttccccgccctcccttttcattcatgcagttgagcgaaaggtgaacaacaggacaggcaccctgtgtgcgacaattaccataacatgtctgctttgggaaacaatgcatatatcccaattgaatggcttgagacccattcattgacggcgcctcgccaccggctttgtgacagaggcaacacggtgcagccagtctgccgcgcggcaaggtgcatgaccgaaataggacacaagagctgatcttgtacatgtgtgaaagtagaccgtattgagttggttgccccgtttccatgcaacgttgagcatcacccaaggataagcgaagcgctacgataggatgaagggaggttcaaatcaccaatagagtttgtgcttaatacgagggtaatcaataaatttggatcgtgataattaagctaagttgtgtagctatccaaacgcttggccgtttgccttcattcgccgtcttcaaacatgaaccattttgtccctttactctttgatgtgttttttttcttcttctttgtagtctatatttattaatacattcgaatttcaactaggaatgaatgaaagaaagagttgaccatcgtgcgagttcaggacgagggcagggtgagggtgttgccgttgaacgcaatcagggtggtggtgccggtgtggccgttcctgaccgcggcgccggagccggtggcgagggccttgatccggtcggtgacagcggcgacggtcgtgaggccctcgaggcccatgaggtaggcggcgaggccagcgacgtggggggaggccatgctggttccgctcatggtggcagtggcggtgtcggaggtgatgccggcactgaggatggagacaccgggggcgaagacgtcgacgacggagccgtagttggagaaggaggccatggtgtcgtcggaggcgtcaatggcaccgacggtgatggcgttgggggcagagccaggagatgtgttggcagcatctttctacaaaggcacacacttgttagtttccatactttcttcacttgatcgaatggttatagacgaaagaacttacgctctcgtttccagcagccacaacggggacaatgccagcactgttcagactttcgatggccaagttgacggcatcagagtaggagccaccgagcgacatgttcataacagatttgcccttcgagtttccagcctcgttaacgatccattgcatgccctcgatgacgtcggagttgttgccctctccgttggcgttgaggaccttgacggcaacgatcttggcgctcttggcgacaccgtaggtggtaccggcgacggtggcagcaacgtgagtgccgtggccgttcaggtcagtgtcctcctcgccggtgacgaagctggctccccaggtggcgcggccaccgaattcagagtggctggttcggacaccagtgtccaggatgtagacagtgataccctctccggcagtggcatcaaagatgtatcccttctggccagcagtggagtgagacaggcgggaaaggccggcgggagcgttgacctggccgagaatggtgttggacttgaccttggcgtcgagctcgacaaggcgaacctcatcggagctggaaatctccttgatcatatcgtcgtcggcatcgatggtcattccacggcggccattgatcttgaacgatcggatgtcggtcgacagcatgtgaccggccatgcttcgcttgttcaggttgcgcttctggatttggccaaggaagtaggcctgcttggcgctgatggcctcatcgctgaaggtggcgttgtacatgacaatgtagcggttggcaatggtgttctccgcaccccagttggagacgaagctggagatgctggagctgccgctgctcacaacgtcggtgaccttgtcaacggcgttgttgatgacatcgttggtggagaaggagacgtcgctggtcttctttggcagggcattggccaaggggagggccaagagcagcgcactcgtgaagagagacttgaaggaaggcatcttgtctgatgatttgggttgggctgaaatgagtttggggtatcttccacaaggtgtggctaatgataacgaatgattctgtgagatcagatcctgcggaaatcacttggaatgaaagtgtgaagttcgatcaagagcttcggtgttgtaagtggtatgtacgtgtcgtgaagattgcttgtatatgcaggtatctgacgataggcggtcaacaccttgataatgggtccaaaagactgtgaagttggagttggctgttgtattgtcttttgttgtgaataagttgggcctgcctggcaataataatagtgaatgtgatgtgtgcgttggtctagtcggacaataaagaagactggatttagaacagcaagagaaagacaggtgaatgaaagaacaaagaaacaagcagcaactatgccaacttgctctgggagtgaccgaggaagatctcaaatcaacagagaagagagtgagggacggagagatcttcttggagggccagatctgggagcaggagtcttttcaacaacgtcccatcccggtcacccacagtcgactggccatgggccactggagccgggggggccctctgcctcgcggcggtccatcgaactggattcaattcgtgtcgtccacccgaagtgcagtctccatgatggagactgtggcaggggatgagtcgtccgggggcccctggacggggacaaccaacagcaaggttacattggttggccagaatctcgccgggaccaggctggtggggactggagtgtgccaagtcaaacgcactggctgtttcgagctgttgcgcttagttttagggtgctctcggacctaaagtttaggtggttacgcagtgtcagccacccaagcggcagctgggccagccccatccaacgaattctggtggcagtcgcacgcaggtacagacacccgacaggggccattgagcccaccgcagggttcggccccctgcaccaccaccaacatccagaacctcaaccacaactagcagttagatagtcgcggacgcctcacggaccacagaccagcgtatgcggcccagccgttatagcttactccggtcgccagcagcctcatccggccaagtcgaagtatcacctgcattgggcagagggcggaactgacgactgtgcctctggcttttctcctccatcatcatcagcaactgactagcatgtggatatcaggtctggacgacacgcaattctcgctctcttccgtggagcatgctcgtcccggcgtctggcagagtacgcaattgctgggcgggccacttccgacccgtagttggcccaatcaaagcttgtttaaacgccggggatgtgactcggttcgggagattgaattctcttgtcgcggaggccattggtcagaagggcctgtgataccaccacgcgctggaggttagggctaatcagtgggtatgcgctgttctggtagcatggcgaaacgctggctgggcagtgtgtccagggcaggcgccatagcggtgcaacgagcggcaacaaagccaaatttgggtcccggcattgagcacccgctgtacatcattgttgtagcggttcctcttctgtcctggcgtggcgcacgcacctcagcacaggcgccacctccactgtggcctggggggggtcttcgggaggtgcctatcggccagccctcaggttctcctatttggcgcagccctcaccaaggcagagcgacgtaggggtcctagtcgcgggagatttgacaaggtgccacagtcctctgtgcctcagattcagcattgccatgggctccatgccgcattgtcgggacatgattggacagcaggggagatgaccggcacctgcggcgtctggcgtgggtctgcgacccctccagcagaatcttgaaacgtgaacacattccggcgagctctcggcatgacctatcaccagatagttcggtcagctcacagacagcgcagacggccgcgtgtgcacgacgctggtcgttttgcgatatcaatattttctgcactggcaccgcacctgcagcaggctattagacattcccgcccgccagctcgaccgagtctgctttctgggcgcgtggctgcagccactcgcatgctgcacacgaacaaggtaaattggcggggccattgttgtgatcacccacgtcaggctgcagcatctttgctttttgattttcccaacgcgagcatgtaatttccgagattctcaatacgctgctgcccattatcttgggctgggcattccccggtctcgaccccaatggagaatctccttccataaactctctagctggcatagtgtggtacgagagctctgcacgccgagaccttggtccaagctgctcaggacaaggcgcccgtaaattgaggctagcaagggaatggtaatacaatgcgaccttatttctcgattcttggtgcccttgaaaccattgccgatgctagcgtcttttcagcggcactctagccgttgaacactttttggatcttgacgagcttcctctgccaagcaccagggagggtttcaggctacagattgaacaacaggagggggtcgtggcgcaggatctcctgggctggcaactcctgacttctgaagtccccggtaagccaatgtgacgaatagtatggtttgagataaaacacgcgtatggactgcagctgaagggtttttatggtatcttggtacgccatattaaaaaaagcacagatctatgagatccttggtgtagccttgcataacgctatggaggctgacagaatgtcagctcatgtgggagcctgcggcttcttttggccaaccataggatttaggaggcaaaaccatgcgccatttgtgtcattgtgatgatgaatatgccttccaatatgaataaagatagaagcagactcacctgccggtttagaccaactatgtgccgtattttaaaataatctttgttagccgtcatgctattgggcatcccagggctgaggtctctcgccacaatggacgatccctgagagctgtacggagtaggcatgtacattcacgacgaaggttgggttaggtaatacaatcgtggaggccagagtggacgggagatcatctatacccggcgtcatagacggccggcactcttggtcggcctccgcggctcggtttgctccttgcgaccttggtctttcaatagctcatccatggatatgaatatatagaatggtagccgtcgtgatatgagaggcaagcctgatatattggacatggccgggaggaaagaatagaatgcctctgatatccactgatcctattccggaacctcttgtggaggtagatcgattaggcttttggcgccagcaacttagtataattgcgtcttgacaattcgcctgcacgtcatgagaaccaataagttggaagatagaacgaggaattgatactcggaaaactggagcatcttatcgatgtgcattccaagcagagactggagttgaggtctggaaggtatcctcgcacggacaatgttctaaaaagatagtattgcattttagccagtcggggaccgcggagccacaagaagataaggatgttgccatgagatatgagggtcatgccgcagcgaagccactgttggtgtgaatcacacatattcaccgctgtggtggttgtgcatgatatggagatggagcaagggcgttgttgatgcgtcatccgtcatgcgttttgcccacctgattgtccaccgaagggaacaaagaagggaagaaaggaaataagcaaaggaagatacagtgatcgatgcacggtagataccacacatgttcgtcattcgaggtggtcggcgtgcaggtggtgtctgtctcagtatcatgtggctcatccagttcacgtcacctcagcctggtgggtgtgcagcgctgcctccaaacgcctggagaggcattgatcagtcgccctcactcctcgtgccggcacctctttgggcggcgggcttctcgtattaggtcaatgggaggaaaacggggacccctcaccagaaggggctttgcggcacgcgacgttgcggctcagatcgatgcttgcacatgaaacgcagcggacggccgtggcataattagcacaagccctgtacaatgccagcgacgaggtgcaacccgagcgctgcctgagactgacatggaagcctgagctgctgcgaggagtatgtgcattacacgctgaggatgcctctgactaagggcaggttccatccactctctccggctgcagccaggtgccccattccggcgagggtactaataatgcaagcacttacaagtagtgctgctggtaccgatggaccattgaatgtgcaattaaattaattagctctctgccatcaccacccgctgtgctgtgcacgtccgtccactccgtccattggtgcagcccagccccaattaccacctcagcgcgtaaagtgccagcagccagccacgcacctccggcaaacaaacacgcagacagacagacagacagacagacagacaaaacagatcggcccccattcgtcgctcgctcgcctcacttgttgggatcgggttccctccttacctatgtgtcgcaacctcattcgcactttccgacagagacgctgacagataccggcccaaggacgtgactcgcctttctggaatgaggacctgctttggtttgcagcacctcctccaccccataccttatcttgcctgtgtaatttcctttcctccttggctcccgcgccttcgctgccccgacgttccaggacatcaataaaactgttcatgccataaccacgacgccacttgatttaccgccactgcctggtcttcgtgcatattctcttgccctgacttgacgttgaaccgcctatgtgccgcggtgggctgggtctagacgacgaccacacggcgccttgcaccgactaattaattaaagacagacacctcagaccacaatctcgttttctccttgcaacacaatctccagccgccaccgccgctgccgccgacgaccacgacaggtgttgttcttctttgccgccggggctgtgttcatgtgagacgtttgagtgcgagtcctctgttgataccaacttctcgggctgggtaagacagcctgctggctgtctcgtgccaccaccctcctgacgccccctcctcatcctatggtcgaaatgtcgaattgtgacgcgagatgctgtcgtcgtcgccaatcccacaagcctacttgccgtcgtctccaaccacagcaccctacccaacactcgggcccccgctctgtaacagccagacgccgacgccgtgtacccaacgctaatgccgaggccgctgtccccgtccaaggaatggagagaatgaggttggaaaactgcatgtcacacgaagggaggagagaggagcacttctttggcaacttcgccgcctcgcccatctccaaactcatcgagccaagttcgaacattggaacaccggggtcgtctagcccacccgccgaagagtccatcgaaatggactttgacactcctctccgaccgaagagcacaccatttccattcaccgagcatcagagatcatatgcccctatggacgactcggaaaatgactcggcatcgcagatggatgatgccagtgattcggagatcacgctgtttgactcggtttaccaagccgtgcccagcattggcctccaagatctgccaatcgaggtcctcgaagccatcttggaccatatttttgggtttcggatatcgccaacctcaagaagcggcatggaagtgtcaagcatccgtaggagctgggggactgccatgcgccacgcgaggaggagacagttgacggagctggccctagttagccaagtatggagaatcctcgtgcagcaaaggctctacaggcacatcaagctccaggggacatacgactcgctggaaggggcaatgctgcactttgcccagaatcaacatctccagccgtatgtaatgcacatggagatatggttcccagtgttccagccctcatatggtcgcctggttatgtcacccagcctaagcctgcctactgtgacgactgatggtctaacgaatgccgcttacgtgttgcctgggaacaattgtaccttggagggagttttccagtttgtggcagccaccctaccccatgtccaggtcttgtcgttggagggaggtgaacgacgcaaggcgcccaaagttcatcattttcacagccgggacaacggcagtgcaggcccgagatcattgacccccatatcatctgtttcgaccttgattacgaagggccagtggaatttgatgcgtgacaacgaggactttgcgaccgtccttggcgcgctaccaaatctgacacactgggacggttcgtacagtaggcccaagtccaagtcttatatcaccctctgcgagtttctcccccagctcccaccaaacatctcgaatcttaagctctgcctcgaaaccgattatcgacgggaacctgtaatgccagcattcttttccaaggccgctgtaaagagccatttttgcagtgtgatggctgccaacttgtctcaactcgagcacttgtcctacacaggccgtgtctgccatatgtttctcgatacggccatgcgatctgtcgatccccgcaatacaaggcttaaatcgctcgatttgaccgtcaagaactgctgccgccctctggctagttttcacgagtctggatcaggaatccatgatctgggctttatcgaggccttcgaaaagcttgtggtgtccgccgttcgttccttggcggtgctaaatcaagtcgaatacatgaggattcgatttgtggacctgggtaaggatttctaccctcaacatcttccccacactcaatggagtactctgctaaccgaaactagattccgtactgccagccttgaacccgttcttcctcttacaaaacggtgtttgctcgggtgtatggagcgagcgaatcatcaacgagatgaaccgcgcacgtccgcatgttacctttgtggagctgagccactcgtttggcaacatcatatataacaaggaaggtcgaatggtggtttccccagaaaacccctgccagaccaagatcacatctctgaaacttgaaaattatcggttgctcgcgaaccgaatgacgatccattgaggaagcctgcaatgaatctcggcttgaactgcgcactaggcttgtaggatccgccctgaagcctcaaacagttttctccctatctcgaagaatttgctgctcattcgactgtttttctcggtgcccttattttgccaatttttgttttgttttgactgacatgaggctgtcagagttacgaattttggaggtgaacgaaaactccgcatttaatttatacccagagtgggcgggctctaggcggtttctggagttaaggatgctatatggtgtaaaaggttggacaggattacgatgaatcggtatgaactgcgggaagagtgttttcagaccactcagatcaaaatttgaggagtgaggttagctattgactaaattattgaagccctttttattctatttgttcggctcgttgaccacgagtaataatgtcttgtgaatatttgctcaccctcgtaacatcaaggagatgagaaaccgtgatagagggtgtgcggtcccggcctagataatgtctactacatagctactgtgtacgagctgcgctcttgccagaggccccgtcactgataatgatgcccaggatccagcaatttgtggcgaagaaggcgagcgaggagagccagagccccgggaagaaggtgctgttgcccaggaactcgagctggtagccctgctggagccaggcggcctgggtgccgacccagagcaggagggcagagatgccgagtctggggttgcggaggagggaggagctggggaggtagagcggtaggaacaccatgtaccagaggaagtactagttataaggaccgtgtgagcaccttggaactgttttcttttcctttttatcttcgtcaaaggagtcaagagagggagtgatgattgcttacctgggaggtgcagaccttgttgaacgtgacaaaggcgaacgtctgggccagcatggaggtggcgaggtccttcttggcgatggcgagggggatgagcaggcaggcaaggaggagctgggggaggaaggcgagggactcggcgtgccacgaggaggaggaggaggaggaggcggaggggtctgttgccgccgagttgaggtagagcagggtgttgtaggcggagaagttgtggcggtggtcgatgcgggtgacgtggtggaggtatgtgtggaggaggaatgggtgtccataccttgaggggaggagggaatcctatagttagagactttgcgaaattacatattggaggttgttgggctggcttacatggagtacatgaggatgttgaggagcatgaaggtggccaggctggtgacggccagctcgaccctggccagcgtgatgaagtacagcagccggtcctttgcagagggcctcttgttctggagcacgacgcagccggtgtgctcggcgtccatccaccagacgatggcgggcgcgtagatgaaggggtagatcttgaagtggacgccgaggccgaggatcacgccggccagccagttccgcctccgctcgacggcccagagcagggccgtcgtgagcacgcccaggaggccctcggagctgccccgggtgctgatggtggcgaccatggggttccagagccagagggcggcgaaggcgccgctccgctcgagggtcatgccgcggcgggcctgcagcatgcggaggaggagccaccccgcgagcaggtcggccagggcgaagacgaccttgccgaaggagaagaggatggaggaggaggggccggcggtgggcaggagaagccaggcgagtagaggggtgtagcggtaggtgtcgcggtcgtaggggctctgtcccttggccaggaggcgggaagcgtcggtgaagacgaggtagtcaatgtcagtgtatttcaaggcggaattggcatcctgccagatgccgtagacaaggagcgtgagacgcagcacagcggctatagagaatagcggcgctggccggaagagggctgaggggatcatggtgctgtggtggtgagggtatcaagagatgagatgagctgtgtatggtcgcacctcatgctcaatgagaaaaaaagaaaaagcgaaagacgagaaaactagatttcaccaagactgagcgattgagggagtggtcgctcgtaggcctcaatcattactcctctgaccccgagatttcatcaagcaccagctcaggtttcggcaatctggctgttatatcaggggtttgggggctctctgtggtgctcagaaaggcagtgttttctcactgggcacagtcgagtttcaggccccacaaatcttcaacctccatccaacaatccatcaaacgacgaggtcatccagagccgcccgcatcctccacaggctataattcgggaatgacctgatatatctatgcttggcgccttaagatacataattgaataccctcatcgacgtgggtagcgctgtcatatttattgtttctaccatgtcgggcgttaagagagaccgggatgggaacgcaagagtgaagccagcaccccaagacggcccccgaggccggttccatgatatgtttgaaggcttcagggacgagcttgacgagcatcacgataggcgggagaggataatcaaggcctctcgtgacgtgactgctttgagcaagaaaatgtgagcaatcatcaacatttttcgttccagagctgtactgctaacgcttggtgctttttttttactgtctcacagaatattctctcttcaaaggtgagcatgggcaggcgaaatctattttcaatggagtctaaccaggtcacagagtcaagcaattaggcaagggcatccccccaggcacacagaaagatgtcgatttaaagcttgaggagatctccaagcttctgacatccgtcgtccctgatctccagtctctcaatcgataccgctactcgtactcactccggtgcctggaggaattcgtggaggctctgtcgttcctgcattatcttcgccatcagaccctcatctcaaagggcgaggttgatgcagcaatgcccgcggacatgtctctcacaccacacgattacctcttcggagtttttgatctgttcggcgaaatgatgcgtttcgcgaccgtgaccacggctcagatgggcgagctggtcggcaacgaggctggacgcaacatcttgtctgacatccacgagctgagctgtgcctatgagatgctgcccgagatcccgaccaaggactacaggggcaagatggaggtcatgcgacagagcgttcagaaagtcgagaagctaggctatggcatcgtcgtccgtggaagtgagcgacctaaggggtggattcccgacatgaaggacgatgcgccggcacccacgtcaccgtgaggtggaactctgtcctttctctgctgagacgcctgttatcgctatgctacgggatttcttgtctttcttgctactctgggacaaatttggaaggtgtctgagactacaaagccattgttgtgttgttctgggaaattgtgcaacctgtgtggaggaaaatattgatgcgtatcgaccccgtcgccttccttggagaagatgacgagaacgacgagagacgatagcaatgatgaaatggcatgaatcgaattctgaacaccaatattacttttctcacaagttgatattattattcctttcttctaactgtgagatcgggagaataaacaatgtctcagcagcttcacttaacatgaaagatgccgtcttaaggcatcaataggaagatagcacaacagtagcgaaaatggaattacgaaagcaagaataacatcaagaaaaatcaccaaagtatgagaaatgggcccgcgcagatttacaatttgaacaacagtcatgagattggaaattgcgtatcacaacatgtgacttttcccattacatgcgatacggtttgcttgaccagcgatgttatttttgaatgcgcaatgaatttcttcatgagcaaatgcccaaaactaggcagcagcgggagattcaattgataaatatgtagtccattcatagctgctgttgagggcattgtgagaacccaacggcaggtgagccggtcactcctattgtccacagtcaacagcgcgtttcggcccgccactgagtcttcgttctcagattgagctcacttgagcagcgcagcttgaaaatcagctacaaaacccaacacttcctctacgcatctcgcttcactccttctctccttgctctacactcaaacacaagccgaatctagaagtttagcagccgcagccaccaacaacgagccatggcctcgtttcaaggtgataacgaccactcgctgccatctgcttgccactaccaacaaaactaacagcctgcaggatccctcgagcctctttgccgccgccaaaccttctacattcaccccgaatggccccgaggtatcagaacacacctctctggccacatgtacgtagagagtcttgagccagagaaggtcacgcagccctaccctctggtgctcatccatggtgacttccacagtggaaaggtatgtaaatgcttgagcattctccaaaggccccttatttactgaaaactcaggtctggctggacaagccagatgggaacccgggatgggcagcctacttcttgaagcaaggctatcacgtctatctggtggacttacctggagttggacgatccggaaagcatccctcgtccacgggaggcaacgtggcgaagctgagctcactcacacctcaaaccgtggagcaagagcttacctgcccggagaagtacccttggcatcaggcgagtgcttgggagaccgttgctcgccatacccaatggccaggtgtaagttatcgccgtcgcattgctgcaataaactatttggaaggcatagctcgttaacaacaggacaggatggtcgccagggagacccgattttcactcagtacatggcatccgtcaccgtccttgagactgatcgctagcagcgacagacccaagctcaggaggcactttccgccctgcttcagagaaccggaaaagcgatcctcgtcggtgaggggactggttgcatcatggcttggctaacaacagatgtgatgcatggcctggtcgctggagtcctgagcatcgaaccttccggaccaccttttgggagcgcccggagcagaggcagactttatggtcaccgtgctgtgtttgatccagaggtcagagaatggggcctggctgacatccctttgacgtacgaccctcccctcccgaagccacaggcgatcatcccagacccaactgtggacaggagaaataaccctttcttccctctttgtgagtacacaaatccagaggatcctcgcaagtcgtgcttcatgcagaatcccgtcagggttacagatggaggcgagatgatcttccaccaacttcttcacttgagaaaggttccccacgctgtcatcacagccgaggccagctcacactcgatcttcgactgggccactgtggctttcatgaggcaggcaggattacaagtcagttggctccgcctcgaggaattgtgcatccgcggaaatggccgcctgatgtttctggagaagaacagcgacgaaattgccctggtacttcacaagtggatggcccggctgccagctgtaaatcagggaatggttgtgcctgcgcctgcgtccgcacttgaggctttacccaagcccgtgcctgggcccaagtctgcaccagtacccgtgagtgaggtagcaaatgaagtggttagtttatcctgcttgtggatgctgttctggggaaagctaatgatgataatggggataaagcatatgtacaactcgggtccttcgagcatccctgcggttcagcctcagggcatggagacacaacatcagatcgaagcagggtggcagttcgtttaagatggccaacagacaagcattgtatcttcgacagggagtctgaagtcgggaaggctaaacaccaaaaaacggagcatctgacagaggatgatcttggatgtggatggattaggaaagtcttgctattaccccggtctcttggctgaagggatcgaaacaatgcgtgctaggtgtgggggacggtgagagagagagagtttgggagcaatggagaggcggtacggggtagggtgaaaaaatttgaaagaagaaaaaaaagatcaggaaatgtctgagagaaaggacagcagagcttttaggaaccaggtctcagaaattagaagcctcgagcaggaacaagaaaagtcacgatgcctcgttccttcccccagtttcagtgcctgttcgctggtgcgggctctgcattccgattggtcaatttgagagcaagggccccgcttttgataatcgtatgaatgactacaccagttacaacacaagccagcttctgggcttccagactcctgcatctaacaagagaattgactgtatccttcatgtcacgtcaacttgcatccgcgttctttatcaacctggtcgttgttgccgctgttcctgatctacccaccacgtctcccccgagatccaggtggaccaaccacagaacctagttccatcgcctgctggcccttgactttgacgccgtcagatcagtcagaccggtttgctgcacttagaaagacagacaaacgtttctttttttcctcctctcaatctctctcgcctccattgctctctctcccgcatcaagaatagaatttactgttgcccaccatggaagcttcccccgtcatgtccttcttcgatgacgacgagtcgcggtggaacgccctgcagacccggaaccccgtctccgacggcttcttcgtctacggcgtgcgctccaccaagatctactgccggcccatctgtaaagcccgcctggcccgccgggccaacgtgaccttctaccagacctcgcggcaggcgcaggacgccggcttccgcgcctgcaagcggtgtaagcccgaggtcgagggcctcatgcccgaggagcgcgcggtaaggcggatacgcgcctttgtccgcgacggcggcgagagcaagtcctgcagagctggcaaggccggcgccaggttaagcctcggccagatggccaaggaggtcggcctgtccaagtggcacttccaccgcgtgtttaagcggtgcgtcggcatgacgcccgtcgagtacgtcaagaggcagcgcctagccgccagcagtagagagtgtccagcagtggacatggtccccgaggacacgacggtcgacccggagcccgtcacgccgagctcgggcatggacgacttctcgtggttcaacgagtctctgttcaccggcaacctgggcgagctgtccgatattggctccagctcagcctccggttctacctccggtcctgggagcgttgttgccctgccgcaggatgacacgctggctctcctgaacgaggaatgcctgtggaccgatttcttacaatggcccgaggacgggctgatccaaactccgtgaaattacatttgcacatgccggaaacatacagacaacaacaagcaatgacacagcataaaggccagacagcgaaaaagggaaacagtgtgacaagagatgacaacagcaactctcaagtgccgaatcgcacttacaccaagaaacacgatcatcttgacccttccctttactgtcatacagcgatatgaacagaatcttgaatgattcaaagaaaagagcacttgctcttccacccagttctctcgcatctggtcattgccttacaggggaatcttggaagcacatcggccattcgagacttgcgtgaacgagggaccactgcaagccgctcgataagctgatatgtgtatttcacttcacactttcccaaggggctttgcagctccgcgaaccatgaattccctgtccagtatgggcatgtgcaaaaaaacagtccccccgaagccggatcaaagtgccgacgagtgcaatcctgaataattaaaagttaccattcgattttacgattttgccccagcaccttgggcacttcaatttcattcaatagtttgataaatacattttgtgtacctgttgcatatggtttgatgatttaacgagcaacaacatctattaacgagacaccccccctcgaaagaattggcaaggaaagttatgggatagggaaaaggatcatttaagcacggagaaaatacaaggaagagatcaagactgaatagcaatcatacagatatgcccaggaaccgagtcctggcgaagaagtggttcaaattgcaagtagtaatgtgtcatgcttttattaaagtggaatgtatgtttgactgccgctggcccgtgctgtatgacaagcatcttgagcttataatcccgtaacgctggtcgctgaataaatcttgaaaggtgaatttccaagtacgtctcataagccctcgtcccacatgtctcatagccgtctcacatttcttggctgttcatatccgatctatggaatgcagaagtcgatccagctacccagataatccagcctgttaccccggaactcttgattccgatagatctcttcgaattcttcaaagctcagtttgccccaccccttcctggttgctgcctcttcttcggcagcgttcagtctcttccagctataaaggtggtgttcggtgatatcgttggcagagccggtttcgctttggggaggtcgagtgtcaggatacgttatcagtcctaatcgaagcacgtccctacacgtcatctggtttgggcggaactgaggaaatgttgaatcacgttcatgggattgccactccgcagcataggcaccaatctgacctatctcagggttgacctcttgttcagcgtcctggtcgatttccggatctatcgagtaaccagtttcggccaagagatcctccagcgactttacctttggtgattgcacctccggtgcgggagacgcatagccctctggtggattaccatcttcgggcatggcaaaagcgtcaattagatctctgtatttttcgcgcatcttcttagttttgcgagcttcaatgtaaagatcttctgagggcttgaagatagcatctagaagctcgttgaatgcttgctgtgtcacctgatacatgatttccttccctgcatctcgttcaacgctgggaatgtcgggagccctccatcgctctgacatgcccctggaagatgcagagtggttggaccggctctcattatcttcgtcatcgtgggcaaactggacttttgagctggatcgtgatcgggataggcctgatgggtgttctgtggatgtggagctctctcccgcctcagtctcgtctagcggaggatattcgtctgcctcagtaaatccttctggagcagtggcgccttcttcttgatcaagataaaactctcgtcgcctccatcggtcatggagtcgtgaccgggccatatcccgcctgcgcttctccgacttcgatagtcgctgtcgcgtgtagttttgagcctcaatcaggtcctcgatttcagtattcatgggccttggatacccattatgctccgtctcctcatctccagattcagcatcatgttccacgtcttctacagcaagagtatggtctcccatcactgcatcgggcagctcgtcgagcgatgtagggggctcaataagtgtaaccaggtaaggtcggtcgccttccgttactcccagggtccttgcatttcggtcgtggctctgatcatcctcctcgccagagctcagccttattcttgcctcggactgccagcgggagggccagtcgccgtcgtatgcgaagaggcttgcgagtatatcctggcgagcaacagtatcatctttatctttggacaccgcagcttgatgactctcggatacttcaacagtaccatcccggtgaacggttttgccttcaaaacgcatgccttcgtccccactaggaacccctccctcacgcccaaacaggctactgagtggttggcgactagccacgagttgttgtgcctccgtgtttgcgaagagttggtcttctaagccatcaagaatatccttgtgcatctgcttatacagcacgtagtaagctcgaaacatgcgcaagaagtcctttcggctcacataaccatccccatcaatatcgtaccccgcaaagatcttgtgtagcttatctttccgtttccgatatgacaatccaatgagaaattccgagaagccaatgtatccgtccttgttccagtcataaaaagtgaacatgcgatcatggataagatttggaggtgcatgacgtgaacgaccggtgggtacaagacatcgttcaaaagtcttgcgatccattgcaaggaataattcatcggggtcctctcgccattctgtatttgccatgaatgtccactgttcccagaaagcctcgagctcgggacgttcaaaaccggtttccttggtgagtttcgcaatcagattctttgggagatttcgtcgacaggtatcagggtcgcccgtgtaccagacgggctgcatttgcctagggccaaacggaggcgcgggaactctaatcttgtaaaagacatgtgtccttgtatgcacacactgtgattcgcaagtctcgcagagatcaaagtcggcgcagttggagcacctatatcgaactcctcggataggcaccatgccgcacgagttacactggcaacctctgtggacgcagccgtttcgctttgcattgtcttccgaaactctgaaaagcagattgacaatgttgtggcccgctcgttggttaggaggttggccgccgtcatctagccactcatcaccactgttatcggcgggctggggctcggtttcggccagaggacgtgcaggaggtatgttggtgttctcgtcgccagcagcgtcgtcggagtcggcggtggaatctgtgtcgcgacggcgagatcttcgtgtacggcggatggcattactgcgatgaaggcgtggttcagtggttgaaccaaagtgtaacgaattcgtatggtaagcatatagtccaatcgacacagctgccagggctgagaaggcggcgactgcaagacgagacctggttaggctctcgacggacggtgtcgatgtcaccatcgtgacggttgtatcatgttggtcgacccagttcgaggcggcgtataactgacaaggacacgtaaatgatagagttacaagatggagcaggatcagcaagctggccgcaaagatgttatgttgttttggaggaagaagctgagctggagcttaaagtgtcttgcggcaggtccatgcgccaagctaccctttggaggtgcttactggattgcgcctgccctgtggcggatgggtcgtactggcccaatcaaatcgatccgcaagtccgctcagggcccatgttcggagttccagttctatttgtggggatctagcacccggtgggctgctagcagtcacctggagcctcgaactatgggacatggatcacgcattagctcccacttccctagtttaccagcgccaatcgagaatccatgatgcaaatgctgcgtttttacttctgaacaacttcggtcaattcgaactctctacctcccgggcgcagcggtattctatccccagtcgatcaaagaggcttcaagatctccctatacgcacgattctccagaaatggccgacagaccaccagtcatgccaggcggcatgccctcgtcgttcgacgacaaccagtaatgatgccactcttgatcgccgacgtttccacccccactaagacagaacatagggtcatgaacgagaagccgctcgtcaaggtcgtcagaaagatcaaggaggagcctctggtgccattgggtatgctttattctttccttccccgcccgatcccaccgctatgctctatactgacgtattccttccccaggtatcggtcttaccgtctatgcgttcgtgagcgcctaccgcgctctccgcaagggcgactcgcagcaggccaaccgcatgttccgagcccgtgtcctcgcccagggattcaccgttgtcgcaatggtcgccggcagcatgtactacagcaaggaccgcgcccagtccgccgagctacgaaagctgcaggagcagcgcgacgccgaggagaagcgccagaaatggatccgcgaactcgaggtccgagatgaggaagagaaggcattcaaggcgcagctccacgagaagctcaaggtcgcaagtgctggaaaggatgagtccgagcctaaggctgagggtggcacgggaggcattcttggaagaatgggtctttggccgtccgggcagaataaggctgctgaggctgaggctgaagtagcgaaggccgaaccagaggcctcggagaagaagcacaagagagagaaccccaagagctcattaggtgccttgggcgaagtgctctcgtcacaaaagaaggataaaaagggcgacgacggtgaaggaaagtaagtcaaggttgagccaccgtaaaaagttgtaaattcaaccgtgtgagaccaggactcattgaatactgtaaaatttccactcttatatccatgtattgtacaaaacaggaggctagaatatcagccaatcttatgtatccagagagaataagtcggtgctgaggcacacttaacaagttcaatgcgcctgctccggaccctaacgccaaattcagaccgctttgatgttaataccaggtgagctccttcaactcgtaaatagacaggctaaattcagcccatggagccaccgctccgatttcccccaataatgcctgccatctctaatacggctctatccgcctcgatgtcacccgttccaaggttgactctgcggcgagattcagcttcccttgcttcccatgcccatctttcagcctgggctttggcttcagcatcgccaccacagccccaaacctcgagactatcaatctggaaacgatcctggaaatcgtactttcgtattttgctgttgtgaaaggcgccgcctctcgattggtaatcgtggttgaacacaccaaattcaaatgaatcattgaagtagagagaaactgggcctagtgatttgacgccacctctccgactggccttggaaggtttcggtaccgggataccaaacgaaagtgaagtttcattccccggaggcttcataaatgcgacataatccttgttaatagttgaggctgggaacacatcgtgaacaggctcgagctggaacaagatggtgtctgagtcgccaaaacactctcggtgggtgtgtctccagggttcccgcacatagacaccaaaagtgagctggtcggacttgctcccgttacggaaccgtttgggaggtaaagagtcggcaaacgaagcctcctgtccaccgtccggaacatccccgagacgggtgcctctcacaagaagaatagttggggcccgccaattgaaaacttttgtctcaaagcttcccatggagaagccggactcgctgccggaatacagcaatctgactcggcggaaaagcgaagaccctggaagaaagaaggatagctgagccagcgtgtgatcgttcaggatctcggctgtgtctgtaaagagcggttgaaccatcgcagtggtatcatctaccggctgaccagcgctcctcacgtgctttgaaaagtccaggttcttggagaacaagaagtgttcgaacaagccgtcgaagcctttaaaaagattggggagcagttccgttattacagttttgaaatgtatgtatttgatcccaggagactgctcaacatcaacaaacgaagcaaggacgcactcggctgttgaacggagatcgtcaattccatcgccggcgatgcggctagagtattgtgacaagctctcctgggcatctaaaggagcagtcagtagcaacagcatcagcaatttcctaaaattatcggtgggtatcattgccccgaggaagctaggggcatcgcctttcttcacagcatcatcaatatctaaaagttcaaatgcggtgaggacgaggtcatcatcctcgtcatcaccaaaaaggtcctcgtcattgccctcatcgccagtggccaagtcaatggcaaaggcaccagggtgggtgcgaggggtttgcgaggatgggttcaccggagatgaaggaacagacatggagtgttttcggtcatggacggctagacttctgaaaagtagcttggtgcgatcagcactcccctttgcgaggacctttcgatagcgctcggtaaggatgacgacaaccataattagctgggggagctccagcacgacaggtgcgttctgcagaaatgggaaagcgccaataaaggatatcatctggaaaataaccggtgaggcgcccaggatatccggtatctcgaggaatcgagcaacggtgtcctccttcaggtagtgaatcgcgtcctggtgatcagagaggctcttgaacacatcttgcagtgagtagaactctagtgagctgaagcacttattcttgaacttatttgcctgttcaaacaggtcagaaacaccgataaatagctgcaactctcttgcgttgagctctcacaagttcatgcgtcaactcctcctgcgaccgacggtacggtggctcctgcgagatcgcttggcccatgttgaacagataatggacgatcacatcaatcaatggcgattcgatagatatgggaggataaaaacaagcagtcaattccctggcctgacagacatgctcctaacaggcaacaataaagtcgtttcactctcagaggcggtatgatcaagcgagacagctcttggagtcgggggctggttactgtaccaaagacccctgcaagaggactttgggcttgtactaggctcgtacctgaccggggctgttacgcctagcgctacctgcccagtacaagcagcgaagggatgctgacgcttgtctgcctctagattggctaccggcgtggatctgccctaccatattggcaattctggggctcggctggagatagagtggagaatgtataaggtcgctcaaaagtacagctggccatcgcttctggaactgcgtactttgagagcaacaggcagtacatggactgacgacaccatcccatcagagttcaggcgcctgcctggcctcatgcggcatcaagatcctgtcgacatcatctatcttagtaagaacgccagcctttatcaagcattgactttatcatccacgacggatcagctcctacccttctccttttctcatgagggcattcctcactactggcactatttgaaccctcacgaatatcaatcgattgtgttttcgttggttggattggagcatagagagctgatgtcgcgaagtcaatcctcttatgtagctagctggcagcttgaaaccacaaaccgctagcctagcagcttagttcgttaggtaccttagcttggatgcttctatagccttctctacatagggagggaacgtaaggtaaaacagacaaaatgctttggtattgatctaccttaatatatgtgtacacactggcgtaatgctgatctcacattaccattggatttttacggaccacgggtggccttttgcctcggtctcctccagagaaattgagataaggccatcagtgaaaggtggaatgggccgacatgatagataggacaaagctcgtcctcaccccctgccccaatccatccaaaccccacgaatatagaatgataaacatagctgtatgcgatggtatatgccaatgagaagaatgtaaaaaggaaaggaaagagaaaaaggacggacagaacgaatgcacattgcaactcatcatagacatacatcatgccccaagtgtcttcttccccttcttgctcgcgcaacccgcacacccgtgatctaccggggagataatactgtttagtctaatcgtttctcgtggtgttggttgtacatggtgttcatcagatcagcgtccctaaactttcgaggtccagctccacttgtaatccaggaaggcccatctagtgagtatcatgaaaagcaaactgacggtgcagagaattccgaaaaatacaacgtccatctgcgggccgaaagaggccagcatctgagcactgagaggcacgcacaccaggccactgaagaaggtttggtcaggcaccgccggatgaatcgacacgaggatagaaagaacttacgcaatgctcagggcaacatgacaggcgctgagataccgcccaaattcctcgtgattgcactgcctttagaaagggaacgtgtcaatgcctatacgttggccatggttgtggggaacttactctcgaacaagaacggatatcatcatgaggaccgcaccatagacaaagccccagaacgccgcgaaaacataaaacttccagatcatgccacccacgttgaagaacaatccaaacatgacaataactgagagtgtcatgatggacacacatgtgttgaagcggccgatggtgtcggagagagcaccaactgctattcgcccaattgctgccgcgctatctgagatatcagcaacttcctcacgagcagtatataaccaaacaggaggcgacttacgcattcatcaccgccacgaggttgaatagggatgtctggtcaaagccctggccttccccccacgacgggagagttcccgccacgcccatcaccgtaaactggaagatggcgagacttgccgtcatccagacaaagtcggccttcttgaaacattcggcaccctcaacgacgcatctcttcaagaccttggccttggcctctttcctcccctccgctttcttgatctccacctccctcttggctgtcaccaccatctggggcggcggtctgaccaagacacagcccagagcgaccaacaccaatgcgattcctcccaccagcctgacagcccactgccatccccagcggttcagtgtctcccgaagcatcatcggccacacaaccccaccgacggagttgccgcccgaagcaatcccattagccagccctctccttttatcaaaccgctggcagacagctcccgaaacagccgtagctacgagcccattgcccgccccgcccatgatgccccaggtaagaagaagcagcccgtaggtcatccggggcagctccgggttgttgagaaaactcatgacaaagacgcccaccacaaacgacgcactgcccccaatcatcaaccacagcggcccgtaccggtcgtagaccggcccagacagcacgggcaaaaagagcgacaggcagatgttcgtgccagcaatccatccaatgtcgcgggacgagaaatccctcagctggttgttctcccagtacgtctgcacaagacccgtggcgttgcctatgccccccgtcgccaccagggacatgaacccgcccaggagcgtggtccagtcggacagcgaggagcccgtcgaagtggacgcccgctccgcctgcttgatggcccgtatctcgtcctcgagctccgacagacccttctccgagtcgccccagtactgctgcgccgaggaggcgttacagagcgtcttgagcgaggcggacgacccggaggtcttcctcgaaaagtttggtagctgcgtcatggtgcccgtcgtgcccggttagggatgttccgaggggctatgcagcctcatttctgcataaaagccgggatgccgcccaccccaagtatatcttctttgagccttcaagggagggtaggggggcaaggctcgcctgcccacaggctggaatgctggcggcgcgttgcccgggtcactcatggggaacacaacgtcaggactgatgaggtgatagaatcttgtctggaaagatcctccagcttgggaatttgacgcaccggctacccgttcgtgtgatctggctgaatcgttgcacgacggccacggggcttgcaagtatggaccgaaacaaacctcagtcggccggtcgtgggtaccgatcacctcctcaacgggactgttaaatgaccttcagtggcgaggggaatatggtaaccccggagagtaattgcgaattcttataaatgaactaaaccatcgctcatgcattcaagccgccctgagggtaatggcgccataccttccctactccataacgatgatgttcttctgtgatattccaaagaccttgtgcatgtcctcgctccatgaaacaataacccgtgtaaaatgaaaccctagtataaattacagttttttcccgctcaacagtcccgacaaagtgaatctgcgatgtgtcacctactcggcctcggtctctttcgccgccacggagccaatcagctttttatactgcagctgggcctcatcatcgtggacacggtacttgcctaggcgccgcgaggccgaacccttctttgagggggccgcgggagcccacagcactgagggtttgtccgaccctacagactgctcctgatcggtatccgcagcctgcggggtggacccagctgtcttggactcctcattgccgtggttgccgttgagctccttatcgccgtccttgtgcgcgtgagggagacgcatggcgagcaacacatactcggcacgcgtcatgttgtccattacatcattcatgtaccggcgaacctcctcctggggagccaccacgcgggccagattctccaaatgcctccctgtgctcgcatacagtcgcacggtgataggctggtaatagtcaagatctgggtcgcttccatactctgagatactgcccttgcgaacaatgaggaatgaggcgacgacctgctggcctggcgaggtaggcaggtactctaaaatgctaaatttggggaagcggtagcgatctcctgtgccaaagtcgaatacaaccgcggaaatgtctggctttggagcaggcgcgggccccttggaccgcaaggtttgggtgttgggatgtgttgctgaatgagcggtcagaccaccgttaggggtcaagccatttggagtagctgctggagctggctgcctcgcttgtggcgtcgcgggagggttcttgggcaggaccttcatgcttttatgtaatctatccaatatgtccctcaagtctgttgaatcagtgtaaccgggtcgcccttcggcaatcctcctgatgatatctcttgtcttcgcaatgtccagagcttccttcacaagcaagacgacgagggggtcgctgcgaggtggcggccttaaatccgtagacctctgctgaggattggaggctagaacaatatcaaggatggctcgtacttcctctgcaaaatatttaacggttcttccatcgacaagtaaccgatcggcagagggtccctgctggccaccatttcttttatattcagcattcaactgatcaataatcttttggaaatgggcaagctccccttcctttgcctgtccaacagccactctcttcatcagatcccggagttcaacatcccctgaagctttttgtgcaagcaaagcgatcacggggtcgttggctgcaggttttgctgcaggagccggcgctgttggtggcttattcagcccaggagacggtaccggtgcaggatgtgccgcggttgggggctgcggcgccgccattggtgttgcagctggcggagccattgcctggccaggggttgagtgtgttgaagtcctaggggggtatgagggtgttgcagcttggccaacagtcggtgttggctgtgctggcggtgcagttcttgcaggagctgtaggcggaggttgcggtctaggggggtagctaggccctgctggtggtggtgctgggttgttgttggttgttggtgtcgggggagcagcagggttcgtagtcccagctgctacctgaacctgactgtttgaaggcgccggcgatatcggtgctggatttttgttcgctggtgaagccgcaggtatggcagtcgcagattccggggcgggggttgctgcgacaggtttcggtgaaggcatcgtcccatttggagggccgtactgaatgataggtcggtttggcggcagcggttgctgttgctgttgctggttctggggtagacgaggcttgggatccttcacaacgtacattgttgcctctacaacatgcggttcaattgtaatcgtgaccaccccgaccttggtcatgctgtctttgggcgggttcttgggatcttcgtggaccacacctttacgcttgtgtggttttgtccagtatttctcgaaaagtccttcgtgggtccatttctgccgtgaccgagacagcgattcggtgagcacaccactgggggaagaaatatgttagctcagtctcagggtgccaagcgaggcggccattgttcgcttccaacttacctctcgcctactgactgatactccttagaagacaggtcgtcgctttgcgcatcctccacggtcggcaggggcttgccagcctggacggagttgggtagcgacggcggaggcgtcggcggtggttgtgagggagccggctcctcgacaggtggttgtacaggagccggtgtttctgatcgaggcgtcgactgccttcgcttagcagcactctcaacacgagctgccgcccggggcggcagttttctcttcctctccatggtgccagaaggagctggccacctctcacaccagaccagaaagaacgtcagagatcgggcgacgaggtggtcatcataagtcgtcctaggttggtgccagagccatacaggatacggtcgaggtgggccgacaaccacgcggattgggacagcagagccaaaagcccttatgcacaaattgctgacagagagtgactggccctaccaagatggagcgtgcagaggctcgatggaggaggagtaggggtgatggcgcattggaagctgtcgaatgaagaacatccgtcttggttcgtcgacgcgcgcgctgtagcgaccttggtgcacaagggcctctgattggcctggtcgttgggaaggcggagtccgggccactaacatggcctgggatcggtgaaaccagccaactcgttgttattatttagtcccaaaagctgtcctggcaagtctccatgaacccaggctaatagttttatacagttcctgtggtgaggtccaggtccgtgatagattggtggcccgtagctccaaagctccctcaattgagccatcgcagcgagcatctcccccatccgagaatagcccagctctggcgatgcgcgaggtcacgatcactaatcggcacgtgctctgcgctgagctgagcccgccacaagcttagcttgctcttatttgctgttggctgacacatcgcccaacctcgcagtgtctctggctgtgacttggctgcgcatggtgatcgtctgggtcgctccttgtgttccctctctcgtaaattgaaatggtccgctctctcgtcccgactctgcggagctccatctgggcggtggccgcgcctcttggcctctatgccctcttcatcggcctgggcgcgacacccttcttccagagacagtgagtggacgttccccaagggactaagccagggatgctgcgccgcgagctgacctttgctccgccacagctttctctatgctcataaggtgaacacactgtcctggactgatgtaaatgagcctgagagatggggattcgccagtcagtctgcccccttgcacgcccactatagaccacttagccgtgctcacaccatggcctgtaggaaatcaagtgacgccgttcaagctcgataccagtgacggggagaggctctatgcctggcacctcctgccgcttcccctatatttgcagaacgaggctagcctggctgcccgggtgccaggctttgccgatgatgttaccactaccgagtcgttccgacttctgaagcatgatcctgaggctagattagtattgtattgtaagagatgtcgatctgcggctcgtaaatcgtcacacgtcgctaaccctcgacagttcacggggtaaaaccaccaatcagaagctggagctggttgatcattcgctgatttgtcgagacagaatgcaggtcatatcgcgcaagcgtttcgcccatccagctatcacaccctaactgatacatcatcttatcacgtattggctgtcgactatcgcggttttggccactccaccggcgtccccagtgagagcggcttgatcgaggatggctcgacacttgtagagtgggcgatcaatgttgccggtgtgccaccagagcggattgtactcctaggacaaagtcttggcaccgcagttgtcagcggtgttgccgagaggtatgctttgaaaggtgtcgagttcgccggcatcgttcttgtcgctgggttcagtgatttggccagtatgctgagcgaataccgcatccatggactggtcccagtgctcgcacccttccgcaactggcagccactgctgcagcttttgcacaagtgcgtggttgataaatggcactcagcaaacaggctctctacaattgttcagagcaccaagtccagactccggctcaatttggttcactcctttgatgacccagacattccgtggacagaggataacaagctgttcaaggctgcggtccaaggaagggagaatatcacagatgatgcggaattcgagacctggaaacaggaaagaaccaaccaaatcagccagaatgcgttcagaactacctggaaagccagtcccaacatcatggttcaccaggagcttttcccttatggcggtaagatcacttcaaagtcactcaatgaaatacatcagaagctaaaagcgtttaggccacaataacattatgggatctgcccctgttacactcgcaatcatgcggtcctttgagctccatggtaccacctatgcctcgtaatacgatccgtcccctatttcctagctcaatgttctgcttgtcttcgtgtcgcgcctcatttacctagacccgtctatatacatttaatatagatctccttctcttgccgcctgggtttcgtctatgaagtcgaggatgacaaccgtgtgtcgtgcatttcgccacgttgcccatcacttcacgtggacactctgaataggctgcatctaattgatttcaaattgacacgttgtcgagacctatgaggaagggtaaacatataagcatttacacggttgcctaaataaattaaactataaattttattcattctaggatatctcgcgtccggtttaacccattcctcttctctaagtctaagtgggctaggtggaattctgtggacgtgaccccacggtagctttggccacttcgcatctaccccgccatccgcgtcgtgccgtgcgtaaatcttcacctccgacgtcaccagggcttaaacgtcgacctattttagctcgctacccagcgaacaacagccgatttcgctgactctgcagacgccggtaaaacatggcgcccgccgaggaatccaagcccgtcgagcccgccgtcgaacagacggacgcccagctcaagggcaagcagcccgccgtcgaatccgagtccgaggaggaagacgaccatgcgcccgacaccgccggagccgcgcccggggcctcgtccagctccggaaagaagaagaagaagtcgaagaggaagaaggcaaaggagctcctgactggcaagtctggcgaccaggaggccgacatcaagaaggccctgggcggcttgaccccacaggggctgaaggagctgctgtccctgaacccggcgctggcgcaaggcatcgccgaggcgtctgggagtgcgaacccgtccgcggaccaagccgccaacgagctgaagaagatgtcgctgcaggagatcatgaccggtctggcggcgggaggtaagaacgtcaaggacatgggagcctacaaattctggcagactcagcccgtaccgcggttcgatgagaaggataagttcgaagacggccctatcaagatccagacggtcgaggacgtgtccaaagaaccagcggccctggtccctggattcgagtgggtggtagtggatttgacgagcgacgaggagatcaaggaggtgtatgagttgttgaatggtcactatgttgaggacgacgaggccatgttccgtttcaattactctcccgctttccttcggtggtatgtatcatcgtgcgctttaacaacgctaatactaaccaagttatatcagggctatgatggctccaggatggcaaaaaaggtaccatgttggcgtccgcgcctcgcagtcccgcaaactcgttgctttcatctctgctattcctcagcacatccgcgttcgagataaagtgatcctctgctctgaggtcaacttcctctgtgtccataagaagctgcgcggaaagcgcctcgctcctgtcctcatcaaggagatcactcgtattagcaacctcgacggcatctggcaaggtgtgcacacggcaggaatcgttctcccccgccctgtcacaacttgtcgctacttccaccgcgccctcaattggcagaagctctacgaatgtggtttcagtcccctgcccgcgggaagcaaaccgcaatttcaagtccgcaagtatgcactgcctgacagtccatcgaccaagggcctaagagctatggaagagaaggacatggatgccgtgatagagctcttcggccgatacacggccaagttcgatcttgcaccgcaattttcgagggatgaaatgttccactggttcttgcccaagcgcgaatcggatgcggatcaggtcatttggacatacgttgttgaagtgagtctcttccttattatataaacctagtggcgacatactgacggcgtaaaaggacaaggatgggaaaatcaccgacttcttctccttcaactgcattgaatcttccgtcatcaggaactcgagacacgaagtcatccgagttgcctacctcttctactacgcatcagagagtgccctcacagaaacctatgaccgtgacgcgcacaagacacgcctcaacgaccttatccacgatgcactaatcttggccaagaacgccaagttcgacgtcttcaatgctctgtcccttatgcacaatggcctgttcctggagcagcagaagttcggcgctggcgacggccagttacactactacttattcaactaccgtgccaaccatattgctggaggcgtggaccgcaagaacctactggacactgaaaacctaagtggagttggtctagttatgctgtgaggttcctgcaattcaggagtaaataaatgaacaggcaaataaacaaataactcaacatatgtaaatttcatcaaggggatgttcagaggttctatcgtaacgacgtgtttgaaaagaaagaaaagtagcgcaaagccccatcaacaccttgtaaaccagaatatatcctcgaaacgtatacgcattcgtatagaaagcatactcttaaaatttctcacattcgcgaatcctctcctcgagcagctcattcagccactgtgccctctccagtggaggggcgtggcccatgccttccacaacgacactcttggtaggctcgatgatgtttactagtcgctcgccattcggggggctgatcatcttgtcaatggttccatggacgaccatgattctatccctccccaccgtgtccgcgatctggcgcaactgctcctcactcttcctgtgccaccccgcagccatcagctggcagacaaatccctggcgggtgaagaacccaggcacgcggcgcttcagcaggctctgggccatgaaacgctggtagttggagtcgaagcggagatacttcccatcctcagtgccgggcgcaggcttgcacttgggcgtcgtgctggggtcgggcaaggtgcactcatcgggcgaggcaagccactcctcggggaagcacttgcgggccgtgcccaggatattatcctcctcggacgtcgggacgaggaagaagaggcgctcccggaagtagtccccgtagttggttgcattcttgaactcggccgtggtgcacaggaggttgagcgagccgagcttctctggtatcttgtaggcaatctcctgtgcgatcatgcctccgagcgagatgcctgcgacgtgaacctggcggtcctcctctgtccagccaagatggtcgagaatctcgatcacgtcgagggccatctcgctggtcgagtaccgtagcaagggcttgtcgctcccaccaatgcctcggttgtccagcacgagaacggagtactggtcgcccttgtcatgaccaaagtagagagtttggcactgccatgcgaacgcagcacccgccaggcccatgatgaactatacaatgagccagattagtaccggattgcgaggctggccggtgaaatacgactaggtttctttatacatacgacaatcttggtagggccggagccatggacttcccatgcgatgttgataggcccgccgcggcccttggcagccgggaaaagaccatgctggtgaggctcaagaccccatactgtagtttgatatgcagggtgcttgagagtttcctcggctgttgggaacttcgcagttctatggatcgtatagtatattagcatgcgcctcagaaaagtaaggatgattacatgatatcagacaggaaactagacgtacgaccctgtcatgatgcctgcgggttggatgcccgtttgatacgtaagccgaaagcgctggttatcgaccgcgaatatgcaaggtggcgtatgtgggactgaggatttgatgtgcttccgcgagtcaaaagagcagatagggaactattatgtaggcagccctccgacatgcagcatcaatagacgttggccagaatctcatgactttgagtggaggatgccgaggcccaacccgtttgcccgtcccccaaaagggagaaagcccgctcccttagacacctatattggactttcgacgtgcgggaacaggatccattcattcgtcatcatcactagtgcattgagtcgtagtttgacccggctatgctatatggattcccagaactaattgttttcattgtggtgctacgtgttacgcctctaccttccgggcatgattcctgaaaagtttcgggacacgcaatccctgttgacagcattggcggcagaccttcctggtggttcgtatttcgtttcgatgcgctatgtctttgttaggcagaatatacacaggcgccattcgccatacgatcgtgatatattacgcgttcgatgctctcgtgatccattcgcagaagagcgctctatgaataattgtacagtacatgcccatcgaggacactctaaatccgacactccctaatccatacgctggaggactaccactgatcgcatgcggcatcgagatctctcatgttgtaaacatcttctggtactggggagtgaacccagccatctcaggcccgttcaggttgcctgcttcatttacctctttccagccagacgtctgcgctggacctcgcccagggccttggtaccactgaggaaggcgacaatgccgacaatgccggcagccggcagggtagcgaacaggttccagctgctgtagtacaggaagaagacaccctccatagaaatgatggaaccgaaaaaggcgaggtgggaaattggagcgctgctcagagcctctccaatgtgagacacattggcgccgagcagaagccactggtcaaatggttagtcgcggcggaacattgaaggagggtagtcctagatagtttacttacacccacgaacagagctggaatggtcgcgacaaccgccagtgcgaagaagatggacactatcttgggtgggttcttgggctcggatcggaaggtgtggtgaatctcgggctgctttccataacgcaaggcaggctcgtaggtcggcttagggacattaggatccagctggacagaaagatcgaagagtggtgagacggaggcggaagaggagccgaacgagcccaggacgaggctggcgtggagtggactttgggaagtcaggagctgaatagggagatctttgtgcgactgtttaatcgtggtgggttagtaggccagccttttattccgtggatgatgataggatagacgaacgatgtcgacggtgcccttgcccgtgttcttcacagtcaagggaaatggggcctccaatccagaagcttccttgaggatcaggaaagcctgatgcggcttctttgacgcggatccctcctttgtcgtcagggacaccttgatcttttccccaactcccagcgacaccaccgaatcgacctgcgacttgtccgacaacttgtggacctggggggagccaccagctctgggggagagctcgacggttccatcagaaaaggtccatgacgaagcggcttgggcaacgccagcaaggagagcaatcgaagaggcgactgagaaccgcattgtgagaaattgggcgggggtggatggaagaagcagaatgctggcgttacagctagagctaggtgagcttcatgagggagcactttgtggtttacgtggttggacggccagttacgtgctgattggagataagataatggggacgcgaaagcggaattaaccaattggaggctgcgattcgctaaagactgggtcctgtagagcctccccggcctaggcgttcgtaatggcttcgaagctctatagctttgactatccgctagaaaatatacacaccaatacttcgggtttgtacgatgaagatagactcagactgcttcggtggtgaattaggttacgccttatcttggcagggaaatacatcgtgaatacccgtttcatcaagctttcaattcttggactttggtcagcagctgtcctcatagcctagctccccaaattaccattctgcttccccaagtctttcgaaatctatctaggtacgttctatatctaccttgatctaattaatccaatagcactccgtcttcacgccctgatctcagaactgtatcctttgatcgcctgctgctcctcctcctgtagttcaatcaggaacaactccccaagagccttgatcctctcttcctcacttctgcattcctgcacaacctgtgtccttcctctaacgttttccttgatgacttcgttcacaagcattcgcttcccataaacctcctgatcatcctcgccgctcccgccctcccgcggccgccgcagaaatctaatcgccagcatcatggtcgtctggaagctgtccggactacacccagtataccaatttgacacctcgtagtccgcctgcagccactccacctggtcgctgaaggtgaagaaggtaagccagggcttgtctgggccgttgcggcactggtagaaccacatcttccggctgggatccaactcggtctgcgccgacatgaagtcccggaccagccttgcctcctgcgtgcccatgttgaggatggtggccccgtccttgagttcgatcggcgccgtggcgccatcgccgccgaagcccacatcgagagtccagcgtgaaccgtcttccagggtgacgatgttgacgatgtgtaccctggcagcattttgttagttacatctagattcagctagagcagaggcgagaaccataccagcccaggtagttgcctgtgggaaccccgttctctcgagtactgactctcacacccacagggtaaacccgaaatccaatagcccgcagcatgtgtaacaggagcaggctgttctccatgcagtagccacctctgcctcgtcccgctaatacaatcttctggaagatgctctgcgggtcaatattgaccactcggtcagcagagtagtggatttttagattctcatagggaaccgctgtgatcatgtgtatatgaatagctttgagaaacgcatagtcgagtttggggttgctctcgagccgatacttggctgggatgtcaatacgagcgaggaactgggaggcctgctcccgcgtgtaaattgcgcccatggcttgtgatgcaattgtctgtaaacgaaaacaacgaaacaacaaaactcaaaagttcattacatagacgctggatcagtctaaaatatggcaggttcattgagtcagaagcgggcttgagccgtttgagaaggtagttgcggagacgatctccgggatcggacccggactttgtcaacggcgaacgagggtattcataagttgaaataggtatgggcttgcgtcgtactcacaggaggatttactggattaaacctaaaacattgatctatatgtcacaaaagcctcgctatttgatatgtggtgagcgccgcgtccaaaccatgaagggtcaaactataagtcctgatcggccatcctataaatccgaccgtttcttctggtctccctgcttaacatctcctaaccggtccacgttcgatcttttgggtatatgatttgccaactctaagaactccatcgagaatgctgttacgatcttcgaccaatcccgacaagtcggtaggtccaagtgctcgccatcatccgtcatcttatgccataggtgccacgggaaggggtcagggatgagatgcaaaatgtctacaccacgggtcataaacgggacgtggtcatctccaattctactgccacgaaaggtagagacgtccttatctgcgtctggcagaaacggcgcttttggcttggcttcgagaatgccaagatcttgcatccgcttctcaagttcggccatacttctgtatgcccagtgggtagtcaagaaatgcgatggaactcgcgggtttgcgttcccgaggagatcaagaagcacaaacagactaatggagctcaagggggtcttatacgtggacattgggtcgtacctttgcgattcccagtccgcagcaagggcactgagtccaagtcagttcttccaatcccatgaatcgtctcagggtacagtacttaccgtgcgccataaatggaatcagtgtcggtccagtctttaaaggcctcctctccgtcaagtagtaaaatctggacacccttgggctcctcaagaccatcctcgccactatcctgcatggacttccacttggaagtcaaagcctcatcaagactcctggcaacgtgcaaaagcatggcacacggcgcggcactgtcaatggcgccgatgaagccatccaacgtggaaaggctgtcgtagtgtgcaacaagagtaagccggccgacatcacccacgttcgcccagggcggatctcgcctgaagatccagttggtaaagggaacttctttatcgcccgaaacaggagtcttaaaggtcgagttttgcgaaagtatctgccattctggcaggctatctcggaagaagtcgacaaagtgccgttggaccttgcgagatccatctgtgtccggcacgcgggggatcaggatgggagccagcagcttgccattgtggatatcgaaatcgtcgccgggcgaaggtatgttccgtaagtcctcgtcagtaagggtcgcaaaggatgaagctgcgcactcgaccagcgcaagcagccatgctgtaagcatcagccatgatgttagcagattcatggtgggcgattcggctaggcggaaaccatctcgcagcgacgcgctgggggatgcaagatcaagcggtccaacgacgagcttgtgttcggaaaactgtccccaggagaggcgtggacaattagtccagttgcgacgggacagcagggagggttgaaggaatggtggtgggatgtggccatctggtcccttacgcattatagccaatggcgcctcactcaacctcaatccattaatagcttggcaagcttagcgactggtccctggttttaggcttcggaacctaatacctacctagaattctggctgctaaatgtgggacacctaccgttacagccactctctcctcgaaacccgcaagtgggtgacaggagaaataagacacctaatggaagggtggttattaatcgactactttctgcaataaatagagagattcagcagtacgaaaataaaataaactagcaatatatggggtattatctccgcagtatgtattattgggactcaataatctgataataccggtcgcagacttaagaataagcagcagcttaatgtttgagtgtctctatttcaatgtcacccacttgacccgatggtgaaacgtttcaagacaggagcaagtcctaagatattatcattgacgctgatccccatgttgagtatcatcaatatttccaacctaagctcccagtgccgatgcaatataatagccaatgcaagggaacaacgaatggtctccgaatccgtctattgattccctctggcgttgagaaattatgtccaagtggacttgttatctggtgaagtcctgatcctacgcaagggatgatcccttgcttagatcgtccacctaccgcagccaatcttggcatcgcattttgagacgaatggaccagacgagtgtgcatctagattagtgtcaaaacgaactacaatcaagggcacggcttactgatgctatggtttcatagctgctgcatcggcagcctagttggccgcacagcctgaatgagccccaagccgaagaactacctaggaatcaccagtctgcatccctccagggttaaggtcgcgcaggaaacggaaatccgtatatttctgatgccctcccttctgataaccataagatcgattccctgactactacattattatggatcgtaagcagatagatgccctgctttctctgacatgcttggtttccatactaaaactaaccctaaccaacatcgtatagcaaactaccgtacacagagcttcctcgccaccttcaactctgtgggtgagcgttcctattcgcttacatagaatcagagaaccatacagaaggccacattggaattggactaatggcgttctatgctctgcacctagcgacccatctcaaaggtgtaagtgccagaattaccagcgtggtacgcactgaagcatgactgagtcatgtcagtgaggttttatggaagatcctgacaaaaaagttgattggctaaaatccagcttgagtgcatcatctcattacgacatggtcgccgctgaggataaattataaggagaacaaattctaggtctgacatcaaatcgtcccatctctattcctgcctggcttacattcgagccaacgttatccatttttacataactttcgtccacaatgaccaaattgaaaagccgctccgtccgtctatagaataaagatgataagtttaagtagcgtcaagagcccacgagattttcaagtcggtccaaaacctccagtgaactctctcaaatatgaagtgtaaaaagagtacagcgatccaacagagtcccgcctgctgtgctacttcgtcaccctgcaatccagcgcattatcaatgcgccttgtttgcagactcgagagccttcttgttcgctatctgcttctccatgggaatcgtcaaagcattgataccaaggaagttgcaaatagcattaacgacaaggtatgcccatcggaaatatgccaccatggcaaaaacgaaatagcactgcaagtagtaaagctccacgtgcggtgtgaccttggggaacccaaacacgggcaggttgcctagaacagcgccgccgataagcggaactagcatgacagtccagtaagggaacggctggcgtgtaaggtgagcgagaatcatcttcgtggtcatccgtccgaagacgaatgacaatgtgagacaaaacaaaacaagatggttctcctccatcaaggtgctatggggcgagtaaacccagaaaccaatggcgagtgtgtaaacagccatgggaatccattcaaggaagacgggagcgattggcaagcccttcgcacggcgtgcgcgtacaacattgtagacacagacagggatgtgacccgtgatcaaggacccaacgataaaaggaatccagatatcaagcacggaggtgctgccgatggcctcagccacctggggcagctggcttccgaaaagaccagatatgggtttcgaccatacatcggggccgtaaattccagaaatggccatgacggcgcaggcgacaaggataccctccgtaggtccattgaaccacccgagatagagtgtgtgtgtgtgatatgtttcccatgtggagaagaacatggcgagacacgggcatagagcggtgtagacgccagccttggaggttccgagacccatggcagcagtttccaaaagactgcccaaggtgcagttcagagagtctattccgtggtcaaagagttcacccagaccgctcgaagtaccagttctgcgagcttgtttgccgtcgacattgtccatggtttggtacatgaaaaggccgaacgcgaaactaaagtatagccaactcgggccctagagatggattagcagagctgccctggagcctcaagccttcccgagaagcctaccggtccaactagatctggcatatagatcaggagaagtccgatattcgccagaatgaaacaaaacccgagtagggtgaccatgttcggtgccagccataggggcaggatcttaacgaaggcattccacttcggcaggttagtattgaaatcgaggcgatttgacgacaggcatggatcggcgtacccagggaccgaggatgtacttggaaacgggagatttgtcgacggccgagtatttgtacgagcgaagatggagcagtgcatcgtctgagatgcactcggcaatggcgttctctaagcgcacatgtcagtaaagccacctcgtcggcggcttccaatttatccacggggcgcggctgagctgcgacttactcgtgttgggagccatcgtcaatatcggttcagcgtcgagaagacctgttcggccagctgctgaggaagtcatgaacgaaaagaaaatcgaccatggatagcggggctctgtcgccgtttaaggaggagctacgtacattttccatggaaggacctttgagtcgtgagcggcgctgttcatcccgaagcaggctatggtgtggagaatagctctcctttctgggcaaggcagggcaggggactggtcagttcgtgaggacccggtctccaattgccacacagtgatggaggggtggtactcggcaagctcttggattggaccatttgtcctacgccccctatattttaattcaagattagggagtacatgtgacggtgaggatttcccgaggctgaaggggctctaaacgctacccacattgaacctcgcattccttgcttagtaaatctggaagttgaggtggccgcgggcatcaaatcaacaaacaacggcaaatttcaatttttggctgcttcacgaggctcacagccggtgtgcaaaccaaattgaggcacccatgcggtgaccagctagcagcaagtctagcagccacgtagtgaatcgcgtccacactaagagacccaagtcaggcacaagtttctgtcaatttcccgccgagcactagctcatgtcgattcggctgtcgcattggatgctgcaagcaaagatcccaaattcctcaaggaccctatgccaaacaagctgcacaaagctagtcttcatctaccattacattattaccacctcgaaagattcacccgaaaaccagtgtgcaaaatgagattatacggaaacgagaacgctcaacccatcaaatgttgtaacccaaaatgatgcaaacaaaaacccaatgtgactgtgttgcttttatagaagagcaaatcccaaaaagagggatccaaggacgacaccgagaccgtatcggctgccaaggccaagagccgaggcggctcccttatctttcgagttgctgggagagccgtagatttggttggcggtggtagtagcgctggcagtcgccgaggcggtggtggtggtggaggaagttatgttggcaggcgtaggatcgagagcaccgcaagggtgttcctcacggcatgctgccttgcaggtgtttgtcgagcatttggcaacgcactgggtgccccattcctggcacacgaagtagggaatggtcaagctgtattcggagacattgggctgcttattgtcgccgcatagacaaccgtattggagggtttccttcaaacaagacgtgtcagtcaatggaacatccatcaggattgacggctaacttacgggatcgcacgtgttgaccttggtggtgcctggctttgtctgctcacataggaaggggcaggaggtcaaggcctgtgtgcaccaatactctttataattcgtcagtttaatctcgacaagcttcgagagaaagaacacccacctcgtgtggccagagggacggagtcgggctcgatatagtaatcggctttgacgacagcggcgaaagatgtggccagggccaggacgaaggttccgaagatcatgattgcggtgatgcgtgacgagatgattattaaaggatatagagttgaagctgtaactgcattccacattggtcagcgtcagtcgaagatgtcaatattggccggctgaaatgtcagttccagcttcaggacttacatcaagttgtagagcagacagctatcttgcggccggtcaacgagagtaaaagggtaaacgaaagaaaaagaaaaatatgtagctcggctcgaggtgaagagcggaggccagcgagtgaatgcaacgagagtaagttattagtagtcgagtgggcaggtcgaaagggagaccaggctgatggaaatggggggattctgtcttcgagggagcaacctaccttattaaggaagcgggtcgcgccggcgacctccaggtccggggggcagggatcatactgacgtgggccaccaggtgctctcaccacctgaagctaaggaagataagttcctggcagtcattttttttcacccgcctctctcatccgtgcacaattattaggttttattgcagaggcggtggcggcaaccggacggcattggccacagctacggaagaagcttaagaaaccacaggaatcctcctctggcctggacttctgggccacccgaacccaaaaccccggccggcatgaaatgggaggttggtcgatcaaagtagatctctgtcgaactttaataaaagcagaacaaaagacgctgttctgtttccgttctcacatctaagcttgtgccatatgtccgtggcttgccctagccagcgtagatcttggcttccaatggcaagccaatgttaatctgtgagaatcgctagtccgtgcatttgcacgagtagtgcaaatgctaatgtgcatcactaccgtaggtgcctcagtggagtagtcaacggcctcaccactcagctgcaatcaagaacccagttccctttgccgcctactcagggggggtaatttactgggcaaatgcctgcaatggcatagctgcgtgtgctgcatgtacaattaaacaagcaccatgctgtgttgttgtctcaactgccagcttggaatgtctaagacggcaccactctgtgtttggtttctgaccaccaagcccaagcataaacccagctacgggatacatatacgagacatccaacatccaacccccagcttctatgtgggaatcggcaagtgagtgagccagtagcaagcacttttttttacggacaaacggactgctgcccggccctcgtattctgtgtcgccttctaatcggtcacccaccttggggtagcatctcgcccgataaagtgtcacaagacaatcgtgttgctctaagctcctgccgacttgccttatgaaggtggagctggagctctgggcgactccgctaaaggcgctaaaggcgcatgcaactgcttggtatctcacaacaacatcgtaatcttcctccccacaacctcaacgtttagttctccggattaaaacacgaggagtgattatggcaggctcgcctatgacactatctaacaatggcgaataggagaactggcctgaggcaattggaaatcccggaggattgtctgggaaaatctccggatgtcaccataacgggaggggggcaaaacagccaagagcccggctgccgcaagaacaggtgagccagcctgtccgtcagataacccgcacaaggtgaaaaacaatgagtgctcctcacacagggcgaacagccggatgcacaggcttcccactcaaaattttatctggggtattcccggaacacacggacttcgtctttcaccctcccatttccttggccctttagaacccttcagtgcgtgtcagacttggcagccttggcctgtctccctggttgcccaaacacaagcagcagatggcaacacatacagccgttgatgcatagaccaagcatcaagcatccatccaatgaatggatgtagataaaaagtatgatatgctgatacggacgatgtcccactgcgccgttgctggaatgttggccccgaccccactgttcgcactagagcagccactgaactcagcacctaaaattcgtcctggttcaatggctccaatgtaacccgacgggactggcaaatcgtcggtggtctgaacttcaatcctcctgccatggatcgatcaccaccagctacctaagcaatatctctatctggcaatccctctccttgcacaaatcgatatcgatattatagaaaacctatcggcataatacttgctctagagcttatcgcgacaagatcgaacatatttgggactatcagcacaccatcctatacctcagtgccgtatccgattcttgcgacattatcatcaacaaaggaaatccagaagcttcaagaaggaccccgcccagccgaaaagcgcatgcgcctgcagaatcgcccaactgaatggcattggcagtagagcgcgatccccttgtgaacggccgttcgaacggtgctcctgtacccaggctccgcgctgcgccgaagccctcgaatgcgcaagccgttcatagctcaacctcgacaggatcatttgaccacacaaactcaacacacgaggagcacccggaattactgagcccggcaacttctacgacactttctccaacgaccccgccgtactggatcaactcgaatatccatcagcgatcccgctccaatgtatcggtcgagtccattcccgcaggcgccattacgctacaggacaatgaaaacaatctagacaacgatcgaaacaacgcatgctgggcgcggagcgtggaaatcatcgaccatattatagtgaatggcagtaccacaaacatcggcgcctttgttgtttggatcatcaaggtcgaaactctcaccgtatgtcaccctgaagtagacaagacagccccaagattcaaatactgatatatatatacgtgagaatacaggggagctatatgaacatccgcaaacgatactcagagttcgacgacttccgcagtcagcttgtcctctcgtttccaaactttgaggcggcggtacctccgctcccccccaagagtgtcatctccaaattcaggccgaagttcctagaaaagcggagggcagggctccagtactttctcaagtaggcaaaattgcttctcgtcacttttcgctctcatattccttcgcacttgctaacattcccgctatccagctgtatattgttgaacccagagttctccggctcgccggtcctcaagaacttcttgtttaaataactatgtcgcagccttgcccgttatggacagatgagccatacggcctgcaaatgatggacagactcttcattttaccaacgtacatgcccaccagttacttggacaatcgcacataaaaaggtggctagtcaccgccacgacataaactcaatgtataattccagctggcggaacattctttggatcggccagggactctaaatattaatgataatgatgttctgaatatgagatgagcgttttcatttatgaatcaaattcagatatgcagccaatcacgctcttcacagtcaaaattccgggaaaaaaagggagaatcctcatcaagtgtggctcagcacagacctgagattacaaggccagccgatcggcccaaataccgtgagcaaaacgccttgcggctcctggagatccctagtaaccgccctcgctcgccaagtattaacataccagcgcggcccggttccacgtcatgcgcctccccacgctaacattgccgagactcatccatggtgccgaacatgcgaagacacactgaaacaagtgagtgtgcatgtatcctaatcccttccagatggagtacttttcttggccgttattgggtggctgtgattatgttttacgcactcgccaatccggctcttggcgtacgcgtatgtctacctcatgttttcttggtattcccttaagtatggctcatgtgtgtgacctttcggcccttcaatcattctctaatccataagcacggcatatcctttcttcgtcttatttcaagatgtgaatgacaatgacaaaaagccctctggtcctctgcgtgcagtccgcataagtaaaaaagaggctctaacacatccaacatcccacgtgtaatcaccacgccgtcacctgtctgtctcgatgacacatgaccgagtgtcaagatggcctatacgtccaaatttctccagcccaacgggccaattggccccaatactaccaccccaccgttccatcacgcccggaggtcggattccaagatctccctgttctctgccgacactgacgtcacaacaacatcttggaccaaaaaatcgcaggcatacatggattcgcttgtccccccttccagggagcaattcgagcacatcgctcgcatccaggagcaaaaggagcaagaaattcgacagagggatagagaatatagacgccagttgaccttgttaaacaaggaacggagccgatccacaagccatgacggccaggataacaaggaaagggagcgggcggcccgactgattcaaaagacattccggggccaccgaaccagaagagaaatggaaggctacagtctggatgctagttcaaggtggatgagtgcgatccgggaggctgagtttcgtcaatatacgacgccgagagcaaggagtgacacggcagggtcgtccaccgggcaagaagacggctcgagcgggccggtcatgtccaatgcgagacgaaactggaagaaggcaagcatagtggctcggcgagccggtcacgacgacgtggaatctgacatatcgtccgtatcatcggcgagctcagacgatgagtcgccggaggagaaggaccgcatccggaagctccgggacaagttactcgctggtcggcgcacccaagcccagatgatgggcctgcaatacttcctggaaatggttgatgtcaagcatcggtacggaagtaacttgcggacataccattctgaatggctgagatccgagacaactgaaaacttcttctactggctagacatcggtgaagggaagaacatcgagctcgactcgtgtccaagagatagactggagcgggagaaggtgcgatacttgtctcgggaagagcgccaatattacctggtcaaggttgacgacgaggggaggctcagatgggccaagaatggcgtccggattgacacgactgagaaattcaaggacagcatccacggtatcgtccctgctgacgaccccacgccagccttcaaccctgaagttgtgccacgtctctcctcatccatgtcgagcatccggagccgcagtagctccctctcctcgctcgagtcgcggcgcgaggctgaccgggccgccaagtacaacgaccccgactttgaccaacagcctccgatgaagaagatcacacacttctctgcttcgaccatctggaacaagatgctacgcaagtctgtccgggatggcacgtggatcttcgtagcagacacttcgttccggctctacgttggcatcaaggcatctggagcatttcagcactcgtcatttctccaaggtagtcgaatatccgcagcaggcctcatcaagattaaaaacggacgcatttcttcgctttcaccgctcagcggtcactatcgcccacctaccagcaacttccgcgctttcgtcaggagtctaaaggaagcgggtgtggacatgagccatgtgtctatatcaaaggcctacgccgtccttgtgggcttggaagtgtacgtcaacacgagaaagaagagcaagaagctcatccaggatatgatgcatcgcaaagacaaggtagtggcgccggaggtggcacaccagcgggaggaggaggccaaggacacgagccaaagtgcgcagagggagagggaggtggtgcaggaggaggaggcggagcatcatgagaacaaggcggcagtcaaggtgatgaggaagttgaaaatcaggccaagtgtccccgagcagctgaggtagaaggggcacacggagcggtgatggccaggcaatgacatgacctccagaggcatgagattttacgctttgaacggccgactaacgaatacccagcccatacattaccgatacacgttatgcattttagttgttaatgttccccatggatctttcttcctcttagatgatgcatcaagccaaacattggtattggtctctgcataaataatgaatagatcatttctcatattttcccaattcggtctgtctcgcagtaaggcgccttcttatgcatgcctagttccgtggtcataaatgatgatatacgctgagagtctaggccctatactcctattgtggcttttgtcctactaactaatagcgcgccacttttgaaagcatgtagccattaggtgcagccaaggcggtagtggtgatgtagtcgagtaaaaaaggaaataatcagatgtctagttgtcaagtgttgtatgtcgttgtctacaccgcaatatgctgagaattcgacctcgcaaatgaccagcactctactgtcgcgtaataataatttagaggcaaagctctatagctagccttggaaacaaatacattaacatcagtgaagtctcggaatatcatgcttcacataagagacttgtttctcacgcttcgttggcagcacagttacagacactgctcgatgagaatcggagtcggggctgacatgaaggcgctctagggtaggcactttgagggacctccttggcgtgcggatggctctcagacttccaggctctaggccgctgaatacagcgcgtacaccactaaaggggccttccaaaatagcaatcgcattcgtggtggcaccaaaatcatcgcttcagaccgcaatcaacaaggttttctatcagaatcgcgtcccgagttatcagaaactgcccgatgacgatcgagaagacgatgtcaggcattttcacggctgcccatggcctccgtcactcgctccagtaggcgagcagacggccgtaaatattctttccagaaggagaacacgtcctcgatgcgagcccgcacagcgttcctccagcatgcccccaacgccaacgttcacggcggagacggcggcggtcgcaccaagcgacacctggacgtgaacgacttcgacacaatcatacccaagaaaacgagaatatccctcgagttactccctccgaagcatcccgcgatctcgagccatgacgacctggcgggcaaccatgccccagctgatctgctgaccggtggcgcggtcggtgccagagggcctacgcaagacgcccctgcacaacccgccccgacaccacatgccgcgacaacggaacagaacctcaccaaacaccagtccaaggtgaccaatggcattaagcatgagctcgatcgcctgcagagccaacccgtggacaccaaggaaacaggtcgcaagcttcggtcgcaagaggctgcgcggcggttcaagagcgaactagcggcctatttccccgaatatgacgaggtgatgggaaacgaggccaaagaacaacgtacgtaccagttgaatgtgttattcccccttccttcgcgtcgcactccgtttctccgtcatttcgtgtacatgtgggctgatgtgagtgcgtttcttagatcttctcaacgtcgacacgccgattgtcgtcattgactcgattgaccaacaaccaccgcagagcgctgtgccacaacagtcgcattttccgataacagaacccacagaaaaaatacccgtccgaggatatggtgatgccctatacacagaccttttcgatacgcagcgcatcgactttgggtttctggtggctcacgacataaacaacaagacattggatgacccattagcggacagcctatttgaacccacacataagcgtgcagagagagtcgagcgctccattcgcaatacagaaaagggacgcgcgcaacatgaaagagaccagattgtgcgccttcttgacagtctcctcggccatgactggctgagggttctgggtgtgaacagcattatagatgccaagaagaaggagtatgaacccgcacggcaatactttattagaggatgccaaaacattctagccaagttccgcaattggagcctagaagagaagcggcgcaaacaggagagggatcgtatgctcgctgagcgagctgaagaggaagaatccgacagcgacagtgagccggagcaagaagagagcgcaggagagcgaaagggccaggccagaagcactagtgaatcatcttcgtgtcccgccaaacagcttcgcgaggaggccatggcacggtctaaggtggcggcaaaggcacccaagcgttcgcgcccaacagctcccaggccaccgcccaaaccgcctggacctccaaaggagttcacctcattcttcggtaagaagtatgaaagagatagtgctctgcatcaccaccggagagcaggccgcaaggtccttgcctgggggcatccggtccctgacgtcccagagtccgacttcatgttgccggaggtgtaccgggacgcggagacgctacgcatgcgagcgcggcagaaaagaagagataagcggagcaccaggaattaatacaccgtgaagagggtattgatattgtgactcgctgctatgcatgaggtctggtggcacttactcctttgttgggttttattgttggtcaaacaaaaatggcatggttttatgtaatacctttatggcggcatggcgtttgggaagggggttttcggattggaacagctctggcaagctttgtgtgtattaattaaataaccgggtatgttgagaaatgggcgtggacaggacctgcagagtagatagagattccacaatcgcgaaagaagcctattgtgagttgcgcatggaaaatatggagccattgtgatgcacgctcgtgagctgccagcgaatgctgcgggtgtaagttcaatacgacgcatcggctcttaggcggctctccgtcaaaggtggcccgtgcacgcagctctcttcgcgcctctcgcgctctgtcacccagatcgacctcatcgcattgcatccttagttttcaaacttgtgttgtcaacggttccgttctttcccgctcgtttgtctagattttccctttctctctttttcatcctgctttcagcgctgccgctgttctacgagccggacgtcgcgtcgacccgatatctccacctgcggattgcttcatgccatgatcaggagccagtaaagcgttggcagctagggtttgatgcgcaacgagtctctgcgcgtagggatattctcgatgcctgggccatctggactgagctctcttgagcatcactggatttaatctcgcgcatctggtaatcggccagggcatcacctaccggcggtcgcggctgcctgttcccgtgcttcacgatggaagccgaaccgaccagcgagcgccatgcgctcatagacgtcgacagcgattacgcccccatcatggaccagtctatcgacgactacttcattataaagcaagacgtcagtctcgaagtcaacttcctcgaacgacgaatcgacgggacgacagatattttcatcgccgtcctcagcgataaggtcgaggaggtggcattggatgcggctcattgcgatatcaacaccgatggaataatcattacggatctgcgtgaggctcatggcgagattgtcgaaggacacaaacgcaaggccacggccacatacaaggatccataccaactgttgagccatccaaagaattggaactggaccgccgagcatcacgatcttcgacgaatgcgcgctcgacaggtgttccatagccgcaagagcgatgtgcccgctgataatagagaggtcaagggttgcacgccagcttatggctccctcagaatcagtctaaaagggaaaggggaccaggatcgcccaaggctgattatcaggaagtcgacgatggggctcgacggctcctcgccgagcttgcacaggcaatacaaaattacaatcccatttactaatacggcaccgcgggatgggctgcagtttgtcggtgtcgatcctttggataatcggttcacccacatgtacactcgtcataccatacacccgggcacagcatcctgcatatttccctgtatggatgaccatggagcaagatgtgattggaaggtttctttcaagtttccgcgcactctgggtgacgccctccaaaaacccctggcgtcgaatctcaacgggataagccatgccagcgtgaccaagatggatattgatgatggcgaccgaggattagatctatccgaggaggacaagttgagagagatgacggtaatatgctcgggatttctggtggaagaaaacatcgacccaaaggacgatcggaaaaagatcatgacattcgagcctgagaagaagacgtcagttcaaaagttggggtttgctatagggccctttgaacacgtcgatttatctgccgagtttcgcacagaggaggatgaggtgaagctcggactcaatgctcttcgcgttcatgcgtattgcttaccatatcgacgtgaatgggtacgcaacactgccgctgccctgaccatggctgcggatcacttgacctacacattcgccaagtacccgttcagcaacttcaagctttgcttcctggacgacatggtggaggagacaatacctctccattctctagctttcattagcactcgcctcctcttcccggaagatatcattgatacggacgttgatgtcacgcgcaaaatcgtcttcactctggcatatcagtggattggaatcaatatgatccccaacacaagaaatgatctgtggcttgtgatgggtgttgctcattacatgactgatattgtcatgagaaagctttgcggcaacaatgaacaccggtttcgaatgaaaacgatgtcagatagacttgttgaagtcgatattgatcggccatcactttgggatctgggtgcgaaccttcatcttggtgatttcgaaatggacttcatgtccctgaaggcccccgttgtgttctttatattagacaagagactaaacaaggcctctggaggtcacgggctgactcgaattctgcaaaagcttctgacgaaagctcaaatcgaaagcagcgacagatctactattctagacacagaaaagttcagagctacctgtgagaaaccaaccagaacacgccttgaaagcttctggagccaatgggtctacggctctggatgccctcgatttgatgtcaaggccaagtttaacaaaaagcgcttatgcgtggagttgactcttaatcagattcacctacaagtaatcgagcaagacagaccgggtctggaaagagacaccttcttgagagccattagggagcgacgggcgggtaccgtcattggggagctacagcctctctatacgggtcctatgactgtccgaattcacgaggccgacggcacaccttatgaacatattcttgaaattcgggaggacgctacgaggtccaccaagttcgagatcccctataatacaaaatataagaggttgaaacgaacacgacgtctgaaagagaagcacgcaggtggtgccaatgctgacgcagctgatggagcggatgaggccttgttgtactgccttggagatgttcttcagacgcccgaggaccagaagcagtgggaactgatcgattgggatccggagacggagcgcaagatggaccaagaatcctacgaatggattcgtgtcgatgccgactttgagtgggctgctggcatgaagcatacgcttgagccgtacatgtacgtgtcccagctgcaacaagacagggatgtggtggctcaacaagatgctatgctttacctggcaagcggtccactgcatcccatcgcgtctggctttctggttcgaaccctgattgatagacgctacttccacgggatccgtgcgatggctgccaaagccttgacgagacaggccaatatcaaagaccttccgatgcttggattgcgacagcttatgatggcgtatcgcgaaatgttttgcttcgaaaacacaagccagcccaagccgaatgatttcaccaacaagcagcaatacaaagttcgtgcatccatcatccaagctattgcagatgtgagggatcatacgcatcgctgcccactggaagctcggcagttcattctcgaccagcttctctttaataataacgaagagaatccggtgtccgaccactactggattgctacccttgttgacgctcttgcaacttctctcattccatctcaagccgatgattggctgacccgccaaagtgctccgaatgaagatgagcgtcggttcctggagtcggcattggagcagattgagcgcgtccttaggcgggacgagtggacaaattcataccagaatgtctggacaatcgctggtctcgatgcgaaactacgcctgatgaaagcagaggtcattcccaagaactatgccgacttcgggcagtacctcttggatggcacagccgaccagatccgtatcaaatgcttcgaggccctggtggacttgggtgcgatcatggatcattcggtcttcacctttctactttacgtcctgtctacggatcgttcaccctttgttcggaacaagctgatccaggccgctgctcgtggccttgcagcagttgctttcggagaacatgagaaggcggagcagaaacctccggcggatcaggatctggattcgggactcgtggttcaggatagtggccaagaaatcgaagctcggaaggagaagtttgctcgaaagcagaatctcgacgcagctctgttggctttgcgaaaggagatggacgaaactttcgctgctgatgagaggtattactccacagccatgcgcaaagctcttgatcacccaacccttggccgtgctgatgtagagagcctgcttgatctggctgcaatgatgtttgacgaggcccgcgattggatcgtgacgctgaatatgcccaagggctggaaggtcgagaggccagcacagcaacttgctgaccgggtaagtcaaagctttccctttaagtttaagatgttttctaacattattattctagttcaacatggtattcaagtcttactataagacaaaacctaaggaacctttcgttgctgctccagcgccagaaccaaagcgaccacccgtcacgttgaccaagacctcgtcaattaagatcaatacaaaaacggccgggacaccaaagccgtctcagcctccaccggtagagaatgggcgcccggcagcatcaacacctgtatctcgtgctccaagtgtgagcacctcacagacaatcagcaacccagacttgtcttctcagacgtcaacaactatcaagagacctcgaccagataaggaagagcccgccgcgacacctgttgcaaagcgtcccaagatggacatctataagaatggcaccgcccacacggcttcgaatgggcctccacggaaacgactcatggttcttctgaaggcgaggcccaagcggctcgccttggctctgggcctgttacaaccctcccaacataggactgggttgccctctggccctaagaaagaagcgtctcctgatggtataagggatagtatcattgccaaaccgaggaagccacttccgacagggggagagccacctagaaaaccattaccggggagcggctcttcagtcacatcgtccatgcaaaagaagtttggaggacgtagtgcctcgcctgcgccatcaagacctgcaccatcaccggcaccctcaatagcaacgccaggcagcaccccggcccgtcccaaaattaagatcataagaaaacctcagcctccacctgccgcctagccaccaccctagttgagttgaaggctgctacatttgttgtcgactttggatgcaatagttccttactttgaatcataaatttattaccccttaagcgatgcatttatttgaatgggaggttattgcgtaatttaacacggcctacgtttgggcagagggaagaatgtttaccacttggtctggtgcgattttgcaaccaggcaggtgggctttgcataagagttttggtgtctgcgcacggaggggcttatatacattgcattggcaggagaatgggagaaaaatttggcgcgaccggcgtcactatacaacgtatcactcaataaccagtgaactttgtgcagtaccgggtcagcccagaacgaatcatttcattcatattgtgagcctgatttgctgattgtttgccgttgccctggccgattgttcttggtgatttcccatttgccccacttgggtggctggtctagggacctgtgacgtgacgcgctcatgatatgtaagctggtatctcttatcgttatcgcaggaaccacgtgatgcggaacattccgccttcagctctgcttgtgcgatcccggtcagatctcatcgctcgctctggcagacaggaagcaagcagattcgtaccaaatcctcgttgtcctccgccgtctcagactcccgccgctcctagcctttggacagagcaggcttacattttatacacatattgttttttacgccgatgattttcagctaatgtccttgtaagtaagccatgatttgttcttgggaatcccttctttgccatcttatttatttgcggctactgcgacgagcctcctgagctccattccgggcatcagcaaacgtccgccgcaaacttctcccctgcgccctttgtcaataccgaacgcgacgcataggcccatgtgccattgctgtagctccttttactcttgggacatgatcgctcataccttattgtctagtctactatgaacagtcaacacccccacggtggtagcggtggtgcgccatacgacagagagcgcgagatcgaagagcatcgtcaccgtgaggaaatggcttatcgcgaaatgaagcaccaggaagagcttgcccgtcgcgaccaagaacgagacgctcgcgagcgaagtgaccgcgagcgagagcgagacgtcaacgaccgcttccagaaccccccccgacacagcagcgctggctccatccctatccaccagcctgttgcatcgagaatctctggcgcgatacatagcccgggcggccttttggcaaaccacaatggcaatccgcctgccggacacctcagcgggcactcggccccggtagccacttttggcggtcccttacagccgagcgaccaacatggacgccaggtccagcacggcggacagagcaatgacaaccctcatcagatattcccatcgatggcacctcaccccccggtcgcggctggaacaccgcagggggctggcgctgccggttcggctgccggtgctgtcttcggtgcgcccatgccccaaggccagcctcagcagcaacaccaagaaggcccgcgaggcgggcagcaaggtggcgcgccgttcagggcagtcacgctgggacagcatcagatccccgggggcatgaaccagggccagcagcctattctaaatgtgagtagattgtttattgagtcaggcgatgcatgttttcctttgtcattgtccgatgcgacaataggttgggtgacgtgaagttgttcagttctgaatcacaaactgcgcggatgtgttttggcgctgctcagccgatgccggcttgggaacccccatctcactttcctctcacttggtttctgcaacgcacctcgtcttttctcccccaaactgcacacccttttcttcctctcccatgaacaagcaaaacaagccactcgtttgactgcaattttcattgctctcctgcatttgcacgagatcatggatacttgcgacatggtctaccaacagccctctccccttgtgcagctggacgctcttgtcggcgacctcttacaaggcggcagaggtattgtctgtacctgtggcgacaatgttaacacgtggtgcctttaccacttctatctcgtactttaactctaatttcaactcgcttaccctttgaattacgctcgctgactatttggtttctaggatgctctcacttatcttgaccaggtcaaggtccaatttcacgaccagcccgatgtctacaatcgattcttggatattatgaaggatttcaaaagtcaagagtatgttttgtctctcttcaggcttcgcaagttgcgaactttactgacttgtataggatcgatacacctggtgttattaaccgagtttcggagctcttcgctggtcaccccaaccttattcaagggttcaatactttcctccctcccggttaccgaatcgagtgtggcgcaggcaacgacccgaatactataagagtgacgacccctatgggcactacgatgcagtcgatcgcgggtcgcggaagccagactgaaagtacggctggaggccaacctccaccattccaagatcggagccagtggcagcgcccgcagcgcagtatcgagagcccagaggctactttcagtactcccgtacagaacacggcaaacctttttgcacaggcagcggctcagaatgggcttttcgaaagttcggcggcttcccagcaacgagctgttgcccagatccagggcgcattggatgcgcagcttaaacctcgaggcgctcaaacccctacgcccacttctggcccggttcctgtaaacggcgccgcaggtaatggcaaccaggccaacatgaatgcccgcggccctgtagagttcaaccatgcaatcagttatgtgaataagatcaaggttagtcaatgtcactttggtgctttacttgagcttcttctgacctgccccactttcacttagaaccgatttcaagacaaacccgaaatctacaaacagtttctggagatcctccagacatatcagcgggaacagaagcccatccaggacgtttatgctcaggttactaacctgttccacgaggccccggatcttcttgaatcgtttaagcagtttctcccagagtcagctggccaggccaacaaagcgaccccaggtcgtgctgaagacccagctttgggccaggtacacacgccacaggctggagcgcgtgacggccagaagatgcctcccctaggaagtttcgccccgcctcccagcacgagcaaggacaacaagaagcgacctcgtgtggctgaaaaggcaagcccggcttcaggtccatcaaccgtggagcctgctgtggccaaccgacttgcgcagccgactacgatcaacggaaacaagcgtccgaaactgagccatgccagaggcactgttgacggacctaacgctgtcgaatccacactcacaccaattatccctgagccttaccctccacgcccggcttctacatcgacacaagatgaaatcgccttttttgagcgtgtgaagaaatatttgggcaatcgatcatccatgaatgagtttcttaagctctgcaacttattcagccagaacatcatcgacagaaacacactcttccataagggcgtccagttcattggcgccaacccggatctgttgagtttttggaagatgtttgtcggctttgaaactcaggatgtagttatcgacaaccgcccagctcctcctactgagaagctttcgctgagcaattgccgtggttacggaccaagttacaggctcctgcctaagcgggaacgcctcaagcggtgcagtggccgtgatgagctctgccaatctgttctcaacgatgaatgggcctcccaccctacctgggcgtcggaggattcgggattcgttgcgcatcgaaagaaccagttcgaggaaggactccaccgaatcgaagaggagcgtcatgattacgacttctatattgaagcgaatctcaaatgtattcagctcctggagcctctcgctcaacagatgttggccatgtcgccagccgagcgagagctgttccatatgcctagtgcccttgctggccaaagcacttcaatcttcaagcgaatttccaagaagatttatggtgaccgaggtattgatgttgtcaatgacctgtacagccatcccttcgacgtggttcctgtgctcctggcacgtatgaagcaaaaagatgaggaatggagattctctcagcgtgagtgggagaaggtctggcactctcaaacagaaaacatgtacctcaagagtcttgatcatatgggcattcttgtcaagtcgaccgacaagagaaacctcaccgcgaagcaccttgtcgatgtcatcaagacgaagcatgaagagcagcgccgtgagcgcgccctcaagggcaaggcaccacgggatcaattcgagtgggactttagcgacaaagatgtcatcgttgaactgctccgtttcgcaatgctctatagcttgaacaacgggcagcacagcttccaggagaaggaacgcattctcgagttcttcgagatgttcatccctgccttcttcgacatttccgaggaatccatccttgacaagctccccaagatgcagctcgactcaggcgaagaggagatcgaggatcacactcccgcagagctgaccaatggccgtagccgtcgcaacgggaagaaaggagatcttcttagaggggtactggatcccggacgcaacggaagcaagcctagaaaccagaaggaggacagcacggcttcgggcagcaaggaaaccacgccagatgtcaattccgccaatgaggaagaaatgcccgatgcacctgatgagagcctcactgaggtctccaatgagcggtggatgcctagtatcccgaagccggttgtcgttggagagaacaacggccttctggattcggatagcaacctcaaggctgatggtcttttcaagcgcaagtggtatcatttattcgcgaaccagactatctttgtcttcctgagcatcttccacaatctgtatgctcgtctcagggatatcaaggagagcaaggaaagcgcccttaatgaggttaagcgccttaaccgtgacaagcccgctcgagatatcggcctgacagagaactacatggcctttttccagcctgaagaagatcccgagacatactggccgaagactgtggaactcattgaagagtacattagcggcgacgtcgacgaaaaccgatatcaagaggtcttgcgtcactactaccttaagaacggatggaagttatacacgctccaagacctcctgaagaccctctgccgtcttgctctcacctgcagcagccaggacagcaaagagaagagtcctgatctgatccatcagcatctcaacagccgagagaagcaggagacaagctatcagactgagatcagcgcaagaaagtttgccgagaagtgtgtaaaggacggagagctgttcactattcgatgggtaagttttttttcttgaactgatcgttatcttgctcttgctgactgtttgtgtgtctagttccctgaagaggccaaggcgacagttcgctggttgcagagggatgagactacattctacacggatgacatgcaacttcgcgagcgctggcagtactatatctcgtctttcatccgaattgagccaacagaaggcattcctcggtcaagactgcaaagagttgttcttgcacgaaacctgccctcgggcgatgccgactctgatgatggagcttctcccaagcggctttcttatgaagaaaacttgaccatcagcatctgcttgagaacctccaagatgatctggggccccggaacatcggagtatttcgtgtatgaccagtctccgaagaccaaggagcagcgagagcgtcgtgaaaagttcactcgggctttgagcaaccatcgtgaactggagctgaccaagaagttcgttcataacccagcctgggcgaaagacttgagtcccgaggaggtccaggaacagaatagcaacttccggaagtggatggacgatggcactcctcccccaaagccactgagtgaagtggacggggagtagtgttcgggttgcctgtgaatcactaatggaatcggattaacgtttaattgggtcatacatatggaagaaaggaagcgctcctattttatatccttgccttttcctctttttgtgttctcttcttccatggtcggctccgacattctacttttcttttcctctcatacatgtatttttcatctgcacaaaaatggggagttgactctcgcggcatggcagaagctcagaccggggtggtacaaggagtgaagcggagtttgtatcagaagcagaggtcaaactaggattttgctatcacatctatacttcatgaaatcattatctttatctgtttcacatcgccttatgacatgatgacggaacggggaatcgtgctgtttgccccgagggccggttattatttcttgattctcaagcatttccgactggtaagtcgtttttggtatctaaacattcgacattacacagattgactccctcctccctttttgacaattttttacgtttttgtttccttttatgtgattagcttattgcaggttctcaatgaccagggcggaagcaccgccaccgccgttgcagataccggcaacaccaatcttggcgttcttctccttgagaacggtggtgagggtggtcacgatacgggcaccggaggcaccgagggggtgaccgatggcgacggagccaccaaagacgttgaccttctcggggttgaggccgaggtgcttgacgttggcgagagcgacgacggagaaggcctcgttgatctcgtagaagtcgacgtccttgtcggtgaggccggcgtgcttgatggccttggggatggcgagggcgggggcgacggtgaagcgctcgggctcgcgctcggcgtctccccagccgaggatcttggcgatgggcttgaggttcagctccttgagcttggcctcggagacgaggacgacggcggcggcgccgtcgttgatgggggcggcgttgggggcggtgatggtgccgtcgggcttgaaggccgggcggatggcgcggagcttggactcgttgaggttcttgacctcgtcgtccttgtcgacgacgacgttgggcttgccgcggccgccggggacctcgacggggacgatctccttgaagaggccggcctcggtggcggcctgggccttcttgtagctctcgatggcgtagttgtcctggtcctcgcgggagaagctgttgtcggaggcgcagagctcgccctggagacccatgtgctccttcttgaaggagtcggtgaggccgtccttgaggacgccgtcgacgagggtctggtcgccgtacttggcgccgttgcggaggttgggcaggtagtggggggtgttggacatggactcggcgccggcggcgacgacgacggacgaggtgccgagcatgatgttctgggcgccgaggatgatggccttgagggaggaggcgcacaccttgttcacggtggtggcaatggtggtctgggggaggccggcgccgagagcggcctggcgggcagggccctggccgagactggtgaaagacattcgttagcacaggtgacgggaagatgtcgaggcgggccattgcattgtctcatggtcaagagaaaaggccggagatgcgcgcctcgcacgcaatctggcttgtaatcacgaagcacttacccagcagagaggacattgccaaagaagacctcgtcgacgtcctcgggcttaattccagcgcgctgaacggcacctgttccactagggttaggcaaactgttgtataatcggacaggagagagatagtacccttgatagcctcagaacccagttgggttgcgctcaggctagagagcgagctgcagagtgtcaataaatgtttggtgggatggcggggtagttgagaaaaacatacccaaggaaagaaccaatgggggttctggcggcagaaacaatgtagacgggagggagattggccatggtgacgatgtggatgagcttgcgggagaagacaggaggaagcagactgctatcagggagaaaagcagagtattaaataggggtggggagaatcagttctcaccgtcttgtatcctcgccgacggtcgggtttcccaccaagagacagcttagcggtgcctctcccaacaagaccgctggtggggttcccgcagcctgtggcgtcagctccaattgggcctagcgctgtcgccggttgtcgccgtacctccaagtcccactgcgagcaaagcgcgcgagtggagccaatatcaacggcaattcgtgatcgtattgcaagtgagggatggattcattgcccctgttgagctgcccgtcgagatcctgggggattgagactagctttgtgtttgcatgtcgaatcgggctttgttatctttgcctgttctggcaggctcatctcacgtatctacatagtgtacctggcatgcttgatagaacaatcagtatacccattgtacaaccagcgaaatctttagatgccgccgtaatggaccaagtttcactatgacaggagagggaattatacatgagtgtttttttccctgttttagatcccgaattttcttatgcatgaactaagcctactatgttggcctctgcagctatgggtcacgcctttaagtgttatcaatctggatctagctcgttcgatcctggagatgtcattggggctgtttcttctgctaattgtgtctattgtgtctgaataattgcgcagtgattgccctcaattttacgaagtggaataactttgtgtgtttggatctgtgctcctcccctccttgggtccttgccagggccatcctaagtagatcattctgggaccccaacgtcaatgatggaatttccgctaagcttcaagacatacatgagccatgctgagctgaatggcatgggtaaatagttcagttctttcgtggagattgcaggttgacgacgaacttcctcccgaatacgaaggtaggcagcaccactatggctagtgagccattgagcaacagttgcagggttgcaccgctgtcttagtcactgatacatccccattccatgcctgctcgaggaaacctcctattgctacaatcttgttcgggccggtggaatgggagacagctgaccagatacatctgggagatctgaagtgacggagaatggatagatagcaccccctgtctaaaatccgatctgtcaggtccaaaggtactgccaggtacaagcgcttgtccgtcagggatctagcgactgggtgtggctgaacagccaatcagggcactgcccgcggatttagtcttcagccttgcatgatttcacgtgatgcagagtgcagcctcgtcgcgaatcagagcagcttagctcaggcccaaaaaaaagttggcgtcacaacgaactgtggttagataccggaagctcgcgaccggacatccacgaaatcctgtactttccagtcgacagtcgcaaatagaggaaccgagtgtaccaattacaggatggatgatctctacgacgagtacgtctttctaattccattgctgtctgaagcacgcagcgcctgtactaacgacgaagctaataggttcggtaactttatcggggaggaagttgagtcggaggagggctctgaggttggcgttgacgccgacgcttacgtatacgacgatgaggccgacgatgcagctccaggtgtgaccggtcaggagcttatggagattgacggtaagtcggggtgcgtctcgtttgacttgcggcctcttgatgctgattgagatgcgctcgcatcgcgcaatctagatggtccctcaaatgctgttattctacatgaggacaagcaatattatccgactgcagagcaggtatacggagccgaagtcgagacccgggtggaggaagaagatgcccagcctcttacgcaacccatcattgctccagttgagcagaagaagttcaatatcgaggaggcagaccttccgccagtgtttttcgagcgcgaattcatgaccgatttgatgaacctaccggaacagattcgaaatatcgcattcgctggccatcttcatcatggcaaaaccgcattcgtcgatatgttggtactcgagacacacgatatcagcgagaagctggaccgcagggttggaaagaaccgagatgagcagttgcgatatacagatattcacatcacagagagggaacgcggcttgtccgtcaaagcggcacccatgagcctcgttctgcagagctccagggggaagtcacacttggtcaatttcatcgacacacccggtcacgtcaattttgtcgacgaggttgctgcatctttccgtctggtagatggtgtgtgtttagtggtggatgttgtcgagggagtgcaagtgaacgcagagcaaatcatcaagcatgcggttttggaagacatcccgctgactctgatcatcaacaagatggaccgcttgattctggaactcaagctccctcccaaagacgcctattttaagctgaaacacgtggtcgaagaggtaaacagcgttatcaccgccgccgctcctttatctgcagcatccaaacgaatcagtcccgagaagggcaacgttcttttcgcttgcaccgatatgggctggtgctttaccctccagaccttcgccaagatgtacacagattcctacggggatattgacccagaagaattcgcgaagagattatggggggacgtctacttcaacccgaagaagcgaaactttaccagaaaacctgtggaagaccgctcagcaagatcctttgtccacttcgtgctggaacctatctataagatttttactcattcaattagcgacagcccagaagatcttaaaccagtactggcatctctgggaattgagctcaagccttcacaatacaaggctgatgcgaaagtcatcctcaagcttgtttgcgagcagttcttcggcagctcaacagcattcgtggatatgattgttcgtcatattccatcgccagtagaagcgtctggcgagtacctgaaaaagtactacactggggatctggaaagcaaagttgcatcatcgatgatgctgtgcgatcaggacgggcctttggttgttcacgtcactaagcttttcaacacctcggacgcaaagaacttttacgcctttggtcgtgtattgagcggtactgccaaacctggcgatcaagtccgtgttcttggcgaggggtattccctggacgacgaggaagacatggccatggcctatatcgggggtgtgtttattgctgagacgcggtacaacatccctaccgacggtgtccctgctggaaatctggttcttctgagtggtgtggataacccgattatgaagtctgcgacgattgttccgcccaagctggaggatgacgaggatgcatacatcttccgacctatcacccatttcaccgagtcagtcctcaaggtggctgttgagcccattaacccctccgagcttcccaagatgttggacggcctgcgaaagatcagcaaatcataccctttgattaccaccaaggtagaagagtcgggagagcatatcgttctcggaacgggcgagctgtacatggattgtgttctgcatgatctgcgacggttatatgccgacatggacatcaaggtctccgaccctgtcacccgtttctgtgagaccgtggtggagacgtcggctacgaagtgctatgctattacccccaacaagaagaacaagatcacaatggtggcggaacagttggagaagggcatctcaaccgacattgagaccgggttggtaaagatccgagaccccatccgcaagacagccacattcttcgaagagaagcacggctgggacaagctcgctgcccgaactatctgggctttcggtcccgacgatatgggacccaacatcctccagaatgatacactattaacatcggtaagccctcttcccaacctcttgaaggtatctggatgtttactgatggtctgctcctacaggctgaagagaaaaagctcctcaacacggtaaaagaatccattcgacaaggtttcagctgggccacccgcgaggggccattgtgcgaagagcgtaagtttcctcacctcccttttccccagccatccacgcgacggactatccttcacctacacgcacacatactaacattcctttcacagcaatccgaaatacaaagttcaaagtcacagacatcacactggccaacgaggccatcttcaggggcggtggccaaatcatccccacctcccgccgcgcatgctactcgtccttcctcatggcgtccccgcgactcatggagcccctctactccgtctccgtcaccgggcccgaggactcctacatggaggtgtacaacgtcctcgcgcgccggcgaggccacgtcctctccgacgggcccgtctcgggcacgcccctgtaccgggtcaacggcctcatccccgtcatcgacagcttcggcttcgagacggacctccgcatcaagacccagggctcctccatggtcagcctcgtcttcgacagctggagcatcgtgcccggagaccccctggacaaggagcagatcatccggcccctgcagcccgccaacgcgcaggcgacggcgagggactttgtgctcaagacgaggaggaggaagggcctgagcgaggacgtgagcgtcaggacgttcctggaacccgagttctaccagtccctcatggagagcgggctgctgggagagatgtaggatatgtatgttctgcggttatggaatattcagagtaggcggatggggaaatcctcatactgacatggttggttctattggcgtcaatgcgcgtatggttgtgcatattagcatagtaattacctatatacacattacattctagggtccagaaaagcgaaagaaagggaaacatagagtacggcatggttgaattcagctgtggtgtttcgttttctcatattctcaagtctgcaagtgaaacgcttctctcattccttttttttttttcctcgtgcagctctgttttttttcccctttccatcttacggtccccagcagcggccatgtttcccgtttccaacctcctccgagcatccatcctctcttccccggacctttgccattttaagacgaagcggtctgagttattttcagtttcgtgaacatagtcatccgatcgtgattttgatccatgtccgcacccacaaccgtctacacatttcaataggctcaaacctcgtgggtaagcggatgctcccgcgaagggcacattttaagcatgtaaggtcccagcgatcagtgtcatgcatgagattaccggcattttctgctgctgcaggtttccacattctatttctagagctgtgatgtgctgtcagaccgtaacggtcacactcgcaaccgcaacgatcgtgctgtgaagtgccttgcagaactttcatttttttgggggaccgaacccgaactatcggcaagtactttgggcagggtttcttgttaagagcggagctagcccggactgctcgactttggcgttagcaggagcatgcttatatgtatcatgccagccgggtcttctagctatgcgcgctcaagcacatgtctccaacatcttgtccaagacgcccttcagggtgtcattttccaaggctgcagctacgcgctccttgtcgctcagctgcttgttcacctgatcatcctggctatggctgttctccttgcagcgcactacgacgcggtagttggggggaagcgcttgctcaaggcgcactcgtacgccaagaccgatgacggttgcgagcgagcagtgcgtgatagtcggcgtgatctcgacagcgacctggacgattgtgtttggagaaggggcaccgagagaaggggagggcgtgatgtggatgtctggaagattgatgacggacaactgtccaagagagacagggtgctccggatcagatatagtggagattagatctataaggatcggtcagcgactgggcaacgacggggcggacgagtacgtggtggtggtggtggtgatgatgatgatgatgatgatgcgaaaacgtaccgtatatctcctgttcatcaatggggtcactgtcgaagtcatcttcgtacgagttgagtttcggccacgagacagccttcaggtcatctacggagaggggctgagagaagtatgatggcttggagaagatgaggtcaccgaacttggagtcagggccctgcctgggagccgtcttcttctgtcgcgtggggagctgggaagcgctcagaatggttgggttagcgttgtcgagcgctgcggcggccatgtttggaatcaacggttgggacgaggacgagggcgaggagttttccagaagggtcacaaggccagggggcgacacagagcaagcttcaaggtcaaatgggttggtgatggaggtgctgcaagccgacggtgatatgtctgggtggtggatgcgcggtttgaccagggtgggtgcatatccagcatggaggggtaagtgctgccctgtatgtaaggcaaggaaggtatgtatgtacctggccttaccttaccactgagccgtccacaccgcatcgcaccgcaccgcaccgtggccgcagcatcccagggactgctagcaggggcagcagcagggccttcgggtgggccctgctaccctgggccctgtcccacaaaagcttgagccagacaagccctcggccggcagtctccgccgcgtgctctcgaggtacctacattgggtcatctgttggtccggtgcggcaacagcgcgacgagtcaagtctgtttggagctgaatcaccgcctgaaacagcgcccctcaagagcttcaagtgccggtctagcggtctgaaacaacgagttggagtcccgatggggacgggatgggatgcgagcctgcacgttgggcattgcgaatctacggcgaaacatgcggaatacttggcgagttaaaccaaggccgaaaagcaagcttcttcccgcagggagatacgtaccccgtaagcagcgtaaggctgagtgaatgatgagatgcaatgcgatgccatgcgatggaaatccatcaattgtgtgttcctgcttctcaacaaggcaggtggctggcatcccggcctcagctctgagcaccgaagtcaatacgaggggtagccatagcggcgagctgtgcaccatccacgagttttcctggtgccatccctgacggatctgtgcgcatctttcgagtccaagcccagcgcttcgtgggtagggcctagaaatgttctcgaaggcctcccgatccaatcaactatcagccctcagaagttccgtagctgtaaagggggggtcgagtccgtggacatgggggtcacctcccacacaggttgcagttgcggtgatatgagccgatgggaaactccgtcttcgtggagagtgtgatcgaccttgctctccctttccttccttttctctagatgctactcttctgtggtgggcctccatctttcctcgttcctctcgccccggcttgggtgtggtggaactgttcatgggaggtaggctacacagtatagttgtggcttgttcgtacgacagccgctgggttcaattgtcataacatttcgtgtaaagagcactgcccaaagaggctcggtgcatgagatgggatccacagcttcgcgtctcctgggaccaaaggcccttttcacaccaggtaggctcgacgcccaatggccgtgtgtgtttccaggctcctctcccatccccatggccagccctcgattggaatctgcccgcagagctaccgagtggaagcatgcatgtttgcatgcatactggccagggtcctgccacgcttttcttattgatactgttgcatcaatacgccggtagcccagcacactttgcgtggtcacatccaggttctacctctccaggcctcatcaggcacctggaggcttgaaatgcctcggctcgctgcatacactagtacgccctggcccaaccacaaatgacaaaggacggtgtggtctgtacatgctgacaggagcatgtgagaccggcgcctgcatccttgtctccttgttttgcttgctgggagcgacccattttatccaaatgaatctctttaataatgggatgttgatgtcatttccgaaactccgggttctggaacacgcaaactcctgtgcgttttttttcacaccggctgtattatttgggcgggagaggaagggggcaaaactaggactgatcaggcatatgttaagccactgcatcggcacatccagagccaacgcgcatctggtggcgagctgcgcggcctttgcttctgtgagacgaattgggcggtctgttaatgaatgggataggacgtgaaagcctcccgtgcctggctagctccgagagcggagcgggctgagaatcaaagccttgttcgtctcttgatcaaggctcccccctgtttactccagatgttaatgatcctaatgacaggcaaggcggccagccctgctgagccaaagcaatactattgaaaagatcgatagtgaatgtgcaggtggccaagaggtgcattcgacaacaggtttgccgaccggattgcccacacgcgtgagaagcaagcccctgtctcggggaaccgggctagggacgggtttggcggagccaggatgtcatccagagagaggagagactgtattcaagagacccaaaagccgtcatctcagggttaattagcgagtggggaacaggataatatgtagaagtaatattgttcgcttcacgaagactgctgatacgcccaaatgcgcacgggtaatctgtggatttcggctgtatgtatttccaatgatgacacatctgctgcactcaccagttgatttcccttatggtcaagggcatttattgagtgggtgttcgcaagctcgcctctgccgtgttattctggaatgctttgaggagtgggaactaagaccaaagttcccaagcccacttgattgggggattagtacctcatcaagctttgacggtcaatccgggagacgctacatagtgacagcgaggtctctccgtagtgctgtcgtcgcggatacccgacgcgtacttttgccgtggtggcaagaagaggcagaagaagagctaacggtgggcatccaggcaatgttggacggttgcagatgggccaagccgaatcacgatcacaaggtgggattgccgtcctctgagtttcacttggtggttgaaggagcccgctctactgtttcatggttattgcgatacccatcatgggactcggctggctgcatatgttggctggagactagcgtcggcaaacatgagcatgtgcagccgctcgtaaatgcggagagcgactagggagccttactcttactcgagatcccgacggcccagcagctgatgtgatgtggtggatatttcaggcaaataatcgcataacaaggagccgcccgacatccagtgcgaccctcgtggtgcggccatggctgtatctgctacctgccgatctgtggccctgctcgatggcacccgagtacactctacatcggacgtcgtaatggaagatgatctccgggatgtccctgcttcttcaccagtagaagtaagatggaagccgcgaggacgcaaggtacggccctgccgccctggctcgcatcgtggcaataggtggctggcgtaatcgtcggaagggggagcaccgctacggtgggggggtgttgaggaagggcagcgaccaaccttacctgaggtacagtaggactcggcttggatcactggatggatgctatggtgcactttctctcagcctaccacctacctaatcgatgccatttcatgataagagtgcgtcgtgagttcatcgccggccaatccccatggctgcgatggccgttgccagtcttgactgttacgcgaggccgtcgaggcagccgtccattgtgcccgcgaagccatgcaatgcaatgtaatggcgagccggtgtttgcttacatttgggagctcttctcatgctatcgtgtaaccaacatcgaggtacttggacaaagctccgctgttggtaacacaagcagcctcgaggtctcaggcctgacttggctggctgtcggagtgcgccgaggagcagagagccctggatcgccctggctcaccctctttcaacccaggtttccagggactccgtatttgttgggtgttatgggtggtgaggaggtgtgcatcagggccgactgcccctacgtggtacgtgttatggaggcaggaggcagcatggcgaaccttggtacctaaactgggtggcagaagaaatgagacatcggatggtatgccggtcctgaccagaccactttctgcgatgatgaggatgatacggcagtgtaaaacgatatacgctagcaatctttagtgcaggattatctcttgagttgtattattagccgtcgataatccgagaataccggttgcagacttgaaaataagcagtatactcgttgagcgtctcaaacagaatgtcacccagttcgcgctatagcgtgctggagcttataggcgcccggggcaaggttatcttccatccagtccaatggatcgggctctgaggttccttcgatcccatgcactgtacgtcgtctgcccgctctagaccccactggagccactgtttgacaactccaccaagcccgccaccagcgcctgctacccactacccactacccagacgctaaggcaaagccaacagcccaaacactaaggacccctctacgaacctacaccccactcgactggcagcagagcgagccctgggatggggatgggggagccaatcttaatatctgccgcgatggaccagaccaacattaacctcaatgggatggggagagatttaggtggtgacaatcgggccctggccgcggtgcgcctgctcctcgacgcgcagaccggtcacgatctggtgagcagcctcgtcgcatagcacatcatttcccggcatgagactgtccgctaccccatgctgcgcgaaggcacctaccgctgctcgcttactagcgtcgcccatcattgccctggatcgatctggacaggctgggaggccaccgagctggagttgggcgcaaaagtgtcatggatacatgccgtgggaggagtcggtgctagttctaggagcccgggctagcaggacaccctaaattctgcgagtgattgtgcgtcaccaatgccgtcgcagatgtgcaagtatcattattacataccacgcacttacgtattggcagagacaggggggcgtttctgcaggacctggactggggctatagcgcccatcaaaactgtaaaaatccaagcatggcactggacccaagcggcagggtcagcccatccatcgttataagcctggaccacctgcgcccagcagtcctccggcacgcgcatgcacccctccctcctttgccggccaacccatcgaccatcgacttcctcagagtccatgcggcagacggccatatccacaatttgatgcctgcacgcccgtgaacgtggatgagggcgaaccagagacagcccaaggtgcagataccaactgtagtttatctgctctacacgccaccgccgtccgatcccgacccgacctgtcctgcgaccgacgacgtcgactcgacatacccaaagctgcttcttccccgagctgaacagagtgactacaccggcttgcattgtctcgcctcgcttctgccgtcggttcagacgccaacctgcgactctaacgccgaccgctcccgcttgcgtatttgaattgccgcctctggtgcccgcgggccttctttgtcgacttgatgtcgactgttcccgcctggtgaattctcgacaggcttgggacgacagtctcgagccatcacatccatcatgtcccaggacccgaatgctcgcgtcctccttcctcagaacccgccgagcgcacatacacctaccttctccgtcgcgccgcagcagtatcctcagagctccgcccaaaagagtttgcgaacccctctccccgccggtagggcctgtcccttggcttgttcaccgtctaatttctatatcccgctagactatgtgtttgtcgacgaacataaccgccacaagcggttaaagggtatgtatccaaccgcgaaacacagcgcatggccatcctactgacaatggtcgtgcagtcatgagggcctgtgagggctgtcgtagacgaaagatcaaatgcgatgccgcgaccaccaacacatggccctgctcagcctgcgttcgactcaagctgcaatgtgtgcgaccgaacggctacgacgggtttgccgactctggcttcgagacctcgatgggccagtcagatcaaatgcagcagatgcagatgcagcaacccatcattcacccagcgcagaagcctggaccgcctgtttatactcaaacttacgctgatatgagtacctctgcataccaaccagtgacgtatgatcccgagcaatcgcaggcacatggtattaattacaccactgtctctcatgttcctgtcatggatcctacatatcagcagggtttatatcagccaccacaattgcaagtatctacgaggcatgaagcctcgcccgaagcctatacacccgattcactacaacagggcgatttggcagacttgctaggaagtttaaaggtggacgagaaaggaacaggtgagctcatttgctgaattcttacgcttcccaatgatctaacgtcagcacagcaccctatctgcgaaacaaggcttcttttgtgcgcgaagagccagcaatggaggatgatgatgaataccaagttgaccttccaccggctcttggccctgggtcgaagattcgaatcccgcctgagttgatgcccgaagaatccgtcgctctgagttacatcgaggccttcttcgcgcacgtccatccatatgtaccagttctaaacaaggcgaactttcttcaccagtggcacacaaacagggaatctatttccccactgatattggaagccatttttgctctcggtggccgtctacgagatgacccgagcgatggccaacaatggttggccctctcctcaagtaagcttatctcttatgcgcccggcgtgttattttgctaaacaagttccagggcatgcggatgccttcctcgatgtcccaagattaagtacccttcaaggtttattgctgcttctcaaggcacgggaggcagttccgaaacgaggctactattaccgttcatggatgacagtggttcagtgcgcccagatgggcaaagacctcgaattggacgaacatctcgatgaccacgcgtcaggtcgtgggtgcgacttcaacactgctgattgtcagcttcgcacacgaatctggcaggtggtgtttgtttgtgaagtcatggttggcgcgccacaaggtctgttgaaactctctgctctacaaaataaaaatttggaatagggatgacggaatattgattgagagaattaggacgcttcgatctttcgatcccggaagataccgtggactttgatgtccatccttccactgttgacggagagggagacaggacctcacgcaactttacttatcttgcacgcgttgttcgcaatgtcaagcgactgagcagcgtgtacatgaaggtgaggaagaagaaggaatggggcattgaccctagagtccagcagttgaaggccggattcgattccttcttgaccgagctccctcccgatcttgccgttagtttccccccagacggctcttctccgtggatccaggaccctttcacaggaaatctgctgtcgtacttctacctcacattgattctgtatcatcggccgcagctctactccattgacccgacggccaaccctgcgcagtggaagcaccatatggtggtttgttatgattccgccaaggctctctgccggttacaggaagcgactgtggcagccggcggcttgggggcgctgcagagcatgcagcggggctacagcttcacggtgtacgctgggttgtcttgcatcgtgcttcatttggtatgttggcgcagatccacgcactggtgtttatattgtaactcattgtctaggttgccgttgtttcgcccgatccggacttgaatacagacgcgagacaatattttacccgccacatgaggatcatggaacaggtaatggatgtatgggccatgcccgagcttcggtcccaggtggaggctgtgcgtgaagcattctcggcggacgtacggaagccctttgttctcaaaccgtcgtttccttatgggagcccgcatccctcgaacagctcgacctcccctaacaggccgcatggctatagaccggattttggtcggactggatctatggaccagcatcttgatgcgcagaacgctcaaaatgttagttatattggacaccccatctctccccccgtgtcgatcggtaccacggatagcaaaggtgactctccagctggacagcccctcatgatgatgtcccaaagtggcccaacgccgggactacaaagtatgccgctcgcagaacaacctgcttggaacccggccagaatcttcgagtgagtgctcgagcgtacctttcggatcccaaccctcgcaactaacgtctctccttaggcactggaatacatccttcggtacgcctgctcaacctaatgcatcctcagccccacagagccggtccctaaatcttgatacttcaggtactgctcaaatctctggcatccaggaataccaggatccgaatgcaggagcaatgagttccagtcagcagtcaatttcgccgcagcagtacactgcagctacaattcctaattttgtgacgccggcaatgtggcaggaatctgtggccagcgtgtatgaaggcggtcttaagagggcttgggactacgattccggcccaatgatgaaacgacgtcaatgaccagctcgctctgctacccatgctactaccccttgaaaccgcgcgagacccgggctcgcgtcgatggcaatgagcttctcacacacgttctaggctcgttgcaaaaactatttcccgggaccgcaccgtatggaacggcgtttttttggttatcgaatttcctggatttcaacttacccgtcttctaggtggacctttcacctattttcttgcatatgtcttggctcatttttgcagcaccgctgcctgtatacttctatggtactggtgtcgagaaagaaagggggacagcatgtgaaatgatccaagcatttgagcatacacgaggaatgcatcaaggaacgatattttgagaggtttctttttcttttttcccgaggcacagacacatcggccgcacggcaacggtattttgagccatcccaagccggcgccgttcttcccaaagcctcaatggtgctatggacattttgcttcttgcttcttgcttctttctttgatcgcgttgatttcccttctttttacttgcccttctcgtggggacgagatacttctctatctacgggggagggtgagagtttgaccggatggctgcttggttttgatacattttttgtatttattctggtgtggcaaaaatgggttgcttgattctccctaaggatggacggacagggtttggcgatatggcttcattctttggagttgggagtgtaggattagggtatctcccgatgaggagtgtcaaagggaaccgggaacctcggctaggcgctctgcatttttgtattgatttgagtacggatagcgatgataccacaatgaatgtgcagggctgttacgcaagctgtgatgctcaggaacatcgcgtggtgtgaactgtgtatgctgtagacaaggagaaaagaaaccactatattctccgcacatcgtttcaacacagatatcggcccattgtcttgtatcaatttgccttgtgatacgctggtctattgctattcgtggcaagtgtcgaatatagaactaggcggctcaaaaaaaaaaaaaaaaaaaaacagtgctcgtaccagctgcaggaacaaggggtgcggatcggtaacgaagcttattacacataagcttgccgagcacgcaaatgaaaattacgcaatcgccgctggaatgcgtgcctgcgttgcagcaatggcctcttggcgttgggttctgccggaggcacgtgggctgtcacttggccaatggctcattgtggctcattgcgaaaaatgaacatgggctgctaacgctaatttaaatatccaagtaggagcccgttcaccagctgcgattgtctccctttctgcacgacgcgaaaacccgaagactacaattgggccatgtctggacgaattgaaggacgggcgcgcgagggggaggtggcagcggctgcgtgggatacagttcgggcgaattggcatctgggctttacggggtttggcggcccgcctgtgcacttcaagatcgtaagtaatacccgtccatgcgcttgatggggggagtgtggtcagcaaggtgtgtgtgtgtgtgtgtgtgtttactgatgacggatgcgatatttcacagttccacgacaaattcctggtcaagctgcgatggattgatgagcagattgtaaggcgtcactgcgttcgacactacggactggcttggctgacatgggctttgggttacagtatcaggaattattcagtgtgtgtcaggttctgagcggacctgggagcacgaagatgctctactgtgtcaacctcatccatggcggattcacctctgccgtgctggcttttctgatctggaggtaaggttggtggcttcatttaattctatgtcctacctggggataaggaaccccatcgccctcgaagcatccttgatcaagtacactgaactgacctctcgcgtaccaagtatccccggggcgctgggcatgtacggcctctccgtcggcgtctcgaacatatccgacacgctgccgaggcaggtctacgcgctcctgtccggtctgaatgcagcagccgtgggcatcgtcatcctggcggccgtcgagctctcccagaaatccatcacggacaaggtcaccaggatcctcgtcttcctcgccgccgccgcgggactcctgtacaacgcgctgtggtacttcccggtgctgatgttcctggccggcctgacgaccattgtgcatgactttcgctggctgcacggcccggtgaaagccgtgatcaacctattccagagaaggagcggtgtcaacgaaggagatgttgaagaagttgagatgacacgccgcgaggagcagagaagcgaaaccagccccggggagtctatgaggacgtcgagagatgttcaacgccagctcacacctccaccggaggagcatgactccaacaaccgcgttggctcttcggccgaggatgaagcacgagtagtccctccggagagacgcttcaacatgtcttggaaagtcggtcttggtgttgttatcgcgttctttatctccttcattgtcgtcatggttcttcggggagttttgccacagaagcccctgctgtaccaactcttctccaacatgtatctcgcgggcaccatcatctttggcggcggccccgtagtgatccccctgctgcgcgagtacgtggtcgcggagggttgggtcagcccgagagacttcctcatcgggctggccatcatccaggccttcccgggccccaacttcaacttcggggtgtacctcggagggctgacggccgccaacgccgggtacaacactgcacttggtgctctgattggctatctgggcatctttctcccgggaatttggctcgtccatggaaccatggggatatggagtgcagtgcgcggggtgcgatgggtcaagtccatggtgcgaggcgtcaatgcagcggccgttggtctgatctacactgctgtgtaccgactttggcagatcggctatattgatgaaggttacaagactgggacgagcatggccgtggagccatggtgggttgttgtaacggccacgagttatgtaggtgggatgtggttcggtgttagcccaccgatgacaattgtcatgggcggtgtgatgggcctgatatggtacggggtggtgacggcttgatatgggggaggacgagaagagggtcttttttatttagatgcagggagctcttttgtgattttctgctggatggcttcccagatccaccactgaacgagatctggttttggtgtttgatacctgaccttgcgtggctgcccaggtcgtccctcctggatatagaatttatcaacagcacgccacatataccacttgcgatttgcattctcctgtgctgtcgaatccgggcgtcgaatgtagttaataagaccgaagcgtcgcttggccggtaggagatcaccggctgccatggtgctctgcctaggcttagcaatgaagctcatcgtagtgagggtgaccttggtcgaggggggcatctcggagcggatgaaccgctcaaggaccgtcttggaagcccgggcctgagaaggcagattgacgtgaacatgcgtcacgaaggatgcagttgtgaaggcgacgaagatggggggcacaatgccgcagagcaagacctgggccgtgtcccagacgggcttctcggacttgatgtaggtaggcaccacgatcccacagaagaatgctccgatgaagagcgaggtgaccttcaacaaggcgatgaaagtcgtgcgggtggtgccggcatggaaaataagcactctcgctggaagagctacatgtttcaaggtcagccagtgccatttgcgcagaatcgtatgaagccttgtcttgtcaccaaccatgttctttggtgttactggccgcggcctttgcgagccgcttgatctcttgctcagcgcgggaaggttttgatgttggttgggcgtagaaacggcgttgaagagatttttgggcagctgagcgcaatgacgaaggggaagatgctgggagctgtagttttcgtgtcggtgacatcaattgggtgcacctggggcgtaatgacgccagcactcggcttctgaagatcatcttgagctgttgattgtgtgatggcgagtgaattgccagattcatgagttgagattttcgagctgtccccaaaatgaagctccgcgattcgttggagacgcgtgctaattagtacatttacaccccactgtagtgactcctacagcagcctgtcgctgaacaggggttcacttcagggagtaagttgcccactatcgcttcgttcagcgcctcaagctccccaagcttcgctccaaggctgatgctcaccaactccgagtatatcaccatggcggaccatagtcactgttcagacaaagaggttttacatctcattggcattgggattttgtttgatgggatgtttttgcattactattgagcctattcacaacttactacgatgaccatggcccgaattttctagtcaaacgacattcttggtcagccactccttccactgatcaggagtccacccagagctgatatcttgaaccacgccgtcaaatacaccggtgggagtgacatggacgccaataaggcggttcatcttggtcacgaccttgaggtcggccgtgaccccgttgcccgagttgagcgagccgtcctcgcctggcttgtccgggatcatgagcagcttgtagacctggtccttgtcaacgcccacgctcccggcgaggtccgccaggcgcctgtaggtgttgttcctggtctcattgacgacgttgacgtcgaagtaggccttctggtcctcgaacagcttggcgctgaagtcccagaacttgtcgggcgccagcttgaggacggccagggcggcctcgtggaccagcgtggacgaggggtgccagggctggacctgctggcggaagatgagggtgaagttggaggcccagacggggttggcgcggatcaagggcacgacctgggtggtgaacgtcttgaagatcttggcggagaaggggcagacgtagtccaggtagagctcgagagtgtgcggagcgggggggacggcggcattgggctgggccaggtccccaaagtgcagtttctggccggcaaacttgggagggagcgccattgtggtgggattcgacagagaagagtggcaggtattagatgctgtgacttgttgtgtttgagtgcgagcagatgaggatttttttttatctacagccgcggtgtttgggcgcgaaggctttcatgtgttagcggggtgagtgatgtgattcgcatggcacattacgtagcttcaatgatgtcaagcagtcaccaataattcgtcaatgggtttggtggatctcagtgctgtctgtaatatgtaattggcccggcttgccggcactcgcttactacagcatgagatgaaactcatggcgagctcgcaagattggagagagtttgataagcatacgctgagcgtatccatggatgccaacagacatggatctaactctagattacaccgtacaacgccacgtatggtgtgtcatattaaggtttgtcatttgagaacctgtgccctctttgggtttctactacagcattacactcgatacttggacgttatgcaattcctttgttatatgatatatgctcttctccacttagatcatcggtcgccaacccccggattactgcaaatggcgattggagccagaatcaacgcctgacttgaatgatgcctatgccgcggtgctatctaagagaaggattctaggcctgagtggggtatctcagaccatccagataggtgcaccaacagtgaagttcttgcttgtcttgtacgccgagtttattcccaagtttcaccgcttccacgtggagatttaccccagcgtaagagtacgtggacaacggcctgcgtgtctcggacaccacggtgacggtctagacgcctaatgaccttacagatcacatactcagaagcatacaagccagtggtgtttcattgcccaaccccaagaagatgacgacgagaccgtgcccctcttctttctgcacttgtggttggatgttggcgatgaccggcatcgtgacgttcagagggcagcctgccattggatggtcgagcggcaccttgttgtccacccgaggacgggagatgtcttggggattgcagctcctaaatcttccgggtgggtgccgcggcggtggttgtcgggtgccgttctatcacaccggctccacgtaatgcgaatgctccattgtcaccaaaggggatagtggctgtgtcgagatctcccccgcttggccgtacaagggtttttacgaggtttccaggtgatgttcatcaaacacacaaatcctttagccggaatggtgttctaagggaggatatgagagctgctgagggtcggaagctggccgattaatggggaggcttgggctattaagtctatctctgatgcatctatagcgggtggaggtgcgctcggcactgaagccattggccgctgaactctgatcggctgcagtccggggtcgtagtgcctgtgcccctcgctgagttcggcctagcggtacgtttatattgccatcgagggtgggcccgttgccgagattgtctcgagtccagagttaagtagaggccattctggaacatttcccccatcgccaagtaacttacacatcgtctccccaaacactcactcttcgtcgtctattgctcgcccacatagcatccgtaccagacatacaggcatacgtaaccgctcaaccatcaacggacgccccaaggtcgattggcggtcaccaaatcgaaccaccatgatctgtctctccaaggccgacgagggtaccttccggcatctgacatataatcagagcccctcgcccctcgctgccgagaataccacttgccaggacatgaatggaatcgctaacttgagggagcatgttgctgcccaccaggacgatgactcgggcggaggcctctgtcattcgtcggctccagatgaaaaatggcaacatggcgaacagcctcctgggccatggccgccgttgtcgggtacgagatggtggtctgcaggttagtcgccctaccatgccctctgttgtccttctgccgtgctgatgttgacacgttttgaacaggatctatctcgtatctcaaggcagcaactggtggtgaagaccagaactgccgtaaacaggtaacctcgccttcctggctctcgcgccttgtgggtgtaattacctggctcctatctgttcttgttgtttcattccttttgaatgaatggaactctcgtggaaacaatacctccacatcgtctacccagtctactactattagccccgttggtttggcccctgttgatgtgaacgcgctgtctgcccttgcctctcgagcccccaaggatgacccctctgtcggatcgctgcgaaaacgatccacatgtactgtgggaggcgtatcaccggagtcatacaacctgccgctccatgttggcgccctcatcatcatctggtttgtctcaagtttggcctgctgcttccctatcttggcaaagcggttccctggcttacgaattcctcaaactttcttcttcttggtccgacacttcggtaccggtgtcctgatagccacagcctttgttcatctcttgccaaccgccttcctctctcttggcaacccatgtctcggcgacttctggacagtcaaattccctgccatgcctggtgccatctctcttggagccatcttccttgtgactattatcgagatggtgtttcatccatctcgtcgctgtacttcaggcatcgatgatatatctggtggcatccagctcgagcaatccgcagaggaagcacacgttgaacatccgaacccgatacgcgacatggcaccacctcgaggcagaactggcagtctaggccatggccttaatcgtctacaaacaagagaggaaagcgtcgaagaggacgaacaagataatcctcagagcgacattgagacaaaccagaaagatggatcttctctcgtcaaagtcaagacgctatctccggaacagaggactcgcaaggaacgcatgcaatgtgtcatgctggaactgggaattctcttccatagcgttttcatcggaatggctctcagcgtcgccatcggcgatgactttgttgtccttctgatcgcaatcgcctttcaccgtaagcacccacctcatcctccttttgaagtttaacctcatctcatacaacctccagagacgtttgaaggcctcgccctggggtcccgtgttgcggctgtgacttggggcaataaaaagtatcagccctggttgatggctgcggcatatggcttgacgtatgttttcccacccccttttctcctgcccacaacaagtagatgcttactcccagatagaaccccccttggtcaagccattggcattgcgacgcacactctctatagcccagactcggagaccggactcattgtcaccggggtcatgaatgctatttcggccggcctgcttacctttgcatcacttgtggagttgatgtccgaggattttctcagcgacgatagctggaagattcttagaggaaagaagagggttttcgcttgcctgctcgtcttctttggcgccttttgcatgagccttgttggcgcgtgggcctaagaagtatgcttgcaacaggctcttttcggcttgtcactcaagtcccccgtggtgcgtgaggtaggcattttcttcgaaatgtcgaacctggtgaggggccctcgcaccgagcacttttgactggagacgattgcttccatgatcaagaacagatatttcacttcgtattgaaccatttccatcgtggttatggctcaacgtccatcttgcttcctttctcttgtccggacttggcacttggttaggacatctttgcctgctcatcttttggatagttcttgtctattctccgtcaaattgaagatgatttacttgtaatatctcccgtactagtacttgtgaaataaatgtagacagcaaaccccaattggcaaaagtcagtcattcatctccagtccccggacgtaccatggcgagccggaatgtgggtgaatgcttacataatgcaccgccttgatgccgaaaccattaagcacaaggtccaactccgacgcaaaccgctgccgcaagaagcttcacatccgaccacccccgttcgaccgcaacaaccatggtcaagcccctcaccttcaagggggacaagaagcccaagaagagaaagcgagcagctggcgacggcgcagagggcgcacccggcggctccaaggaccgggcgctcgtcgccgccaccgccgccgaggaagaagccgccaacgacgacagctgggtgtccgccgactcggtcggggacatctccggccccgtcatgatcgtcctgcccaccgagaagccgtcggcgctcgcgtgcgacgtcaacggcaaggtcttcgccatcgacatcgagaacatcgtcgacgccaacccggcgagctcggagccccacgacgtgaggcaggtctgggtcgtgaaccgcgtcgcggggacggagagctttcggctgaagggccaccatgggaagtaagtcgcgtgcggagcaattgctgctccttcattttctctctccctgctgttgcttttcttcaagctaactctggtctttcaagatacctctcttgcgataagatcggccagctgtccgccaattcagacgccgtctcccccctcgagtcgtttaacatcaagcccgacgccgaggcgggcaggttccagctcacgacgctgcgcgacacgtacatctcggccaagacgtccgagtccaacggcaagcccggcgtgcaggtgcgcggcgacgcggagacagaatctgtcagcaccacggtccgggtgcggatgcaggcgcggttcaagcccaagctcaaggcgtcaaaggaggagaagctccagtctaaaatcagccggcgggagctggaggaggcggccgggcgcaggctcgaggaggacgaggtgaggatcctgaagagggcgaggaaggagggggattaccacgagaggttgctggagatcaaggtcaagaacaagcacgacaagtttggttgagtttggccaagggtttagacacgccttatctatatttgagctctgaagagtcccctgatacgtgggtagcgccaatgccctcggatggtcgtgacaggtaggcgaccttgggctggaagatggcatgccgattctatcactcttcggctccttgcggccccaaggaataattgagcgccggggactgacatggttgccagagaacatgagaggttgagcttggtcttgggaattgcacgttggttcctctgttaagcacctacatatagacctgggccggaggattgcttcatcagatattactcgccgagagagaagaatgaaagaaagaaagaaaaacagatacccatctaaaattcatgtctcataagtccaattttttagttacccggtcgccaggccttgaccttcccatcctcgccacccgtgaataccatctggctctcgtcgaagaagcaataagcccttacgatctcctcaccatgcgcaccaggcagaccaacgctgtttccacggttcacctcccatgaaccctgattgttcgtcaagaacatcagctcaaacttttgctggctatggtttccgacaagtgttagcactcccttatatgtaaaaaagaacgtttctgtaggattgtaatgagagaaaagggaaaaagaaacctactcttgcgcaccagcaccgacgatggcaccgctcccgtcattcttcggcacgatgtccgccacgtactggcattcgttgtcccgtctcaagtcgccaaagtccctgatcgcatcccccgagccctgggcctcggagatgtcgtagatggcgaaccgctcgtcgtgggacagcgcgtagacgagggaggggcccaggaagccggccctgtggatggaggcgttgaggttcagcgtctgcaccgtgagctcgtcctcgtccgcgatggaggtgtcgtggacgctgacgaggccgtcggtagagccagagagcagcacgttggggttagaggggtggtaggtcagggtggtgatgtcgtcggagtggaggtcatggtatgctgccttttggacgggtgccgaacgaacatcccttcaatgacggtataagtaaatgggcaaatgggcattactacaagagatgggacagtcgctcataccagagcaagatgctggcctcgtgattgtggagttctgtgccgaccgcaatggtctgggtttctgggctgcatgccattgaagccaacggtgcttcgctcgcttttcatgtgaagggttcacagcctctgttagtctctgctcgtcacttacacagaccggcgcgggctcactcactggcaaattgcacgacctgggctccagctcggagatcccagaccccaacatttccattctcgcctgctgtgcataccacgttgtctccaaagagcctcagtgcagtgaggttgccatggtcagtctggaagctggagacggggcccttgctgagtgatgcagggttgagcagagagagcttctggtctgaggaaatcgagacgaggccacccgggggggttctcaggagatcgaggacatagacatcgctgccgaagcgatgctcgtctgttgttgtgagcgtgtacattgcaagtcttcctgctgcgattttgtgtgtgcttcttcgatgcgaaatcgtcgcttaaagattttctgagttgctcttttagtgctgggctggtgcggagctcaccagatgggccatctcccaccatgttttgcggcacatgctgctcaagatagtcgggatctggataggtctttcagtaccatgcccattgccccatggaaatcaatgtctactcttctttctcacatagttctctaaaatcgaatccttcatcgacgctgtactcactacatatgctgacgtaattcgtcgttgccatgaatccccgttgtttggacagagatggcttcgcagatatcgcaaaggaacgtcattgtgctgctatatgtacagttatatttagcgtcggcgtcatgagaggggttattattacgtccttcggaattgtgttcttgttttctaggtgttgactaatgtttgtgtctgtctcagaggagcccaagctaaggttgacaatactgatagtagtaatacacttgtttgtttttatttattacttcataagctatacttcgtgagctagtctttggcctgcacagctcatattgaggagatggtatatctgaaacgacgcgccgatctatcaaaacgccccagccaatgcgtaatggaacaaacaacccaaacgccaacgagtttcgacctccttttacttttttttcttcaggtccgtatataaacattttgtacattgaattacagccgctcatcttcacgcttcaaggcagcacgttcattgacaccgtggaacgcccgcttgccaacctcgtacgtgctgatcatgatggcgcacgagggtgcaaccttcaacatccgtggaatccagcccttccacaagccagtaacgccctctttctggaagatctgcaagagcaagcgagccatattttgttgctccggtgcagccttgccagcgccgccgacggtgcctgctgcgtcgttgtaaacctgggtacgagtcttgccaacgtcgaagggggtcgtaacaaaagaagcaaaagcacccgaaagagcaccagagacgaagctgtcgacgaatgcctctgtatgattctcgtaattttgagggtggcgtctcaagtcgccgtgcgcagtcaagggcccatgccgagaatcctcccgagcggtgaggagtcttgtacggatcgtctcatatccccaccagtagagaccagaaaacgggacgtctctccaaagcgtgagggtgaggcccctccataatgacccatagccatgtgcagcaaccatctctttcacgcccttgaatgtctccatcatgtggtttgctccggtagtgctggaggcggcttgcatccgagtacggatgagttcgatggggctgacggtcgttgcagcaaatactctagcaagagatcctgatgtcaagggggcgtaataatcggggagtttggacagagggctcttcgagtcatatcgcagccattcgtagccagtaaagtaaattatgttagccgggactgtcataacgagtgtgggtgacagtcctctccagagactcggaattccttcgtttcgagcaatctttcgaataccatcgagagtcgacgtatacgtcctcttctgaacctcctggacagcacagtcggcggcgttggcacttgccgcgatgctctcggcacccctgggcactgctaaacagtattcggcggtatttccagggaaaaagacctctcggcagcaagccgtgacacccacttcactggcctgggccaccgtaagctgcctcgtctttattgcgagtttggaaaagtcgatcggggatgtcggcgttccttgggactggagtcggacacgaacaacgtcaagcggcgtgactgcgagtatctaacattagcctacagcttgtcttcagccggtcgtggtagggccgggtacttacccaggagagccgtgagaagactgccggacatggcggagaccatcttctgtcccgaggtgatctccagcgcatggttcgggttattatgggagccatcgtgggagcggctaagcgctccgttgttcggtgccatgttctcggcgtgccttgaaactggtttgggatatcggccgtttaaattgaactgaggatatttaatcctcagttcatggcctggctcggcgcggccctcggtggcgatcgtaaatgcccgctcagtcgtgggttgatagtcgtcgattgaagcctcggaaaatgcgggtacgagcaatggggagaaaaggtcaaagtttaggaattgggggaagagggggttagagagaggacatatagactaggtaggggagaggtggagggcggcgactttccacctagtcgggtcgatgactctgcgccgggcaaactatgacatggatgaaagcaccgattgataagggcggcgggttccagaagatttgggctgggcctctggttgcaccgttttgcttggacaatttcctaagcctccgtttgccggcgatgcacaattacggcggggcttccgattgccgcgactccgctaggcaggagctgtgcgctgtgattggcccaaaggccgatacgggccaagacccgtgaagaccatcgaggttggcggccatcgatcgctgtagcacttgcgagcaggcaaaacagctcgtcttcacgtggcaatgatcagctcacccgacagatcacatatcgccaccacgattcgctgcgacgttggatgctgccaagggacgcacttgggtggtacctgccgacgagctcctctctctgtgctctgtggcgtgggaggtcgatagagtgtcgagaaagcactaagtaggcagctgttaaccccgatggatcgagctacagccgaacatgactacctgcgcagctgtggacaggtacctacctacgtaatcgataagcagacagccccagcgcccgctatggccatgtctctggccgctaatccttatcctgttcgccgcccggggagtcatcacaacctccactattccgcctcaccagcacaaccatctgcgactctcacgccgacgcctattcgggaagacactcaatcctctcctccatcccatctgcctctgtacgagccctgtaataaatacaacgtgctccgccggtcctcatccttgaaatctctgcttccattctagcagttcacaatgtattcattaagctgattccaattagagagcacgcaataccctgcccctctcaccctctaactccgctcaccgtgtcttatctcctcgaccactgagcatcactcttcacatcttatataaaccatgtcagggtccaaggatcctaagaacgatctcaactcggagctcgagtcgttccggcagcagtggatttcagatctacgccacaaggacgaacccgccgctgcctcgacctcatccgcaggcccgttgcggccgcgagcaccctcttcgtccttccagcatcccatcccgaagtcaggctacctgccgccgtccggtgggaagaagaatgtacccgtcgaagatgacgacgaatactttcaaggccgctcctttgacgagctcccggccccttccggccatacactagctgaaggcccagctcagccctctggagagaggaaactcgtctcggccttggaccatttcgaggaggccatggagaaggaagcccaaggaaacatgggcgccagtttaacactgtaccgaaaggcctacaaggtaaacatttccttctcaactttcagaatgatgtaatcgtcatggttactaattgtgtttctctcaagctggacaatggtgtagacaagagataccgggagaaacactttcccggtggttccaagccacatgctatatcccatacatcagcagctacggcatcctcatctaccactgccgcaaagaattccgcgccttcacagcccggtgcggccaagccggacgaggagccggcgcagcctctcacaatcccagagctcctggcaagcttcgccgagctaagcatcgaaccctcgcccccggaggtggagggcatgccgcaacccccttgcccaatcgcctcggtgccagacgagatcctcgtccacgtcctctccgacgtcgccatccacgacatcgccgccttcgcccgcctctccctagtctgcaagcgcctcgcctacctcgtcgcctccgagaagcgcatatggcgcgaggtctgcctcggcagcaagttcggcttcagcggcatgcgcttccactggaacaccaacgtcgactggacccccctcgaggagcaggagcaggaggagcaggccgacgacggcaccctcgtcagcatgcgcgagctcgaggcccgccgccgcgccgagagcctcgccgtcacgcactccctcacgccggccgtctaccgctcgtggaaggccatgttccggcaccggcccaggatccggttcaacggcgtctacatcagcaccgtcaactacgtccgctccggccaggcgtccaccaaccaggccacatggggcggcgcccccatccacatcgtcacctactaccgctacctccgcttctaccgcgacggctccgccatcagcctcctcaccgtctccacgcccgccgacgtggtgcaccacatggccaaggagcagctggagtccaaccgcggccgggaccgctcccacgcccacagcctcccctccgccgtcatgcagcacggcctcaagggtcgctggcgtctctcctcagccgtggaccacccggacgcctcgaccttggccgagcaggaaggggacctgtacgtcgagacggaaggcgtggggtcccagtacgtctacctgatggatctttcgctgcgcagcgccggcaagggcgccaggaacaacaagctggtctggagaggctaccacagctacaacaagctaacagacgacctggccaaatttgagctgaaaaacgacaagcccttcttcttcagccgtgtaaagagctttgggttcggggaataaaaaccacaagtggaactaggccggatggaaatttcttttctcatatttatcaagtatatatatcaatatatatctagaaagaagaaaatgttcaaaaaagacaaggggaaaaaaggtatatgggatttattcccagagaagataaaaaaatacttcgcgatcattgccttcatatcggccaaaacagccaagtcgtcgtaaatttggttccgtgtccctccctatgtacgtttcgtacaccacacaccctgttagcaatcataccaagcccccnnnnncccagcaatatcgaaatgcctcgattaaaaagttaaggtgttgaaatatggtcgctagagttacgccaaactctaaaagaatcttataaaaatgcgagggatgagagaaagaaaaggaaaaagtcaggtaaatgccaagtggtgtagtttgtttctggggtccctcccaacgctcatacgcttgtagtaacaatgtccgctagtaattgcaaatgagaaatccaaaggaaaaggagatgcgaagggctagacgaagtcaagagatgactagttcccgtcgctatatcaacatctaggtggtcaaaggagcgttcattctatagccgacctccaagcgtgctggggtagcagaggcgtggtgaataggcttattctgtcgttctcgtatcgacgggttgtaacgttgagctgcaaaatgatttcttgggtgcccaggaagagtcgctacctcatccgttttccatccaagaacttggggtttttgtctttataataattctcggaatattgcacagttttccgggcttcaaaggctgcccgctcctcatcgtccatggtaaaggctttcttaagccagccaaatgcactctttttcttcttcaatgtttgattcgtcgttgtccgtgttgtccgtgtggaatgtgtgaccgtgcgcatgctaggggccccatactgcgatcctccataatgcccactgtcatggtagttcccgcggtctccataatgcccgggcgctgaactcatagttgtgacacgggctgcgttgggacgaatcggtggtggcatggagtcggatggtctcctgaaggtctgaggatggcctccaggaggtcctgctgcggtatgtggccgctgctgtagtggggagtggggagacgcaagaactgggtggtactgtctaagctcagagcttctcgcttgcaccacttgaggtcgaagttcagtttgtgagccaattcgagtcagataatgctgacggtaggcatcagcctcggcagatgaagcagatccacgacctgagacgtcaagatttcggggcgttggaatagaaggtcgtccgttggctgagccgtatgaatcatgaggcattgaaggtcgtccgttcgccgagccgtaggaatcatgaggcctgcggtctcgagaggtattcacacttgcttcactgttccgcagagaacttcgcacaggaaggaaaggcatgccaaattgcaagggtgagccggaatcggaagatccatcagatggtgaaggcggattatctctgacgatatctctaaccataggggagggtagaggctcaggcggctgaggcgtataggttcgaggttggagtaaatacagctcttctgtctcgggctcaggttgagattcagattcgacaggcaacttttcgtccattatcgtagcgtccagtacgatgaacttggactctgtatccatgtgcagtgtcggcgggttgatcggcggcttcttcggcgtcgccttggaaatcatcatgggagggagcagaggaagcgcgccagggactgggaaattgctaaggccgtcatcgaagtcgatatcatcgtcatcttcttcctcttcctcttcctcaattttctgtggcactccatccttcttcatttcggccttcacctcatcctgaatttcgagtttcacctctaccttcacctcgtctttcacctcttctttcatctcaaccttcagctcaatctgcacctcatccctcacctcctcttccaccgaggtggctcggaatattgggcccgaacctgaaccactcttgatacttgctcgcctggctgatttggggatagaaataatggagggcactaatgacatggaagatctatctttgagacttggaatgctggtgacagggctagtcgccacgggagacgagaatggagggatcgcagactgagaacgattagcaaagctctcatgagaatctactgcttgtgaacaagataaaacttacccaggtcttccgactaacttcaccagctttcttctccatttctgccgtcaacccagacagttcggccacacgtttattgatgtcctcgacccgacttcccatttcaataaaagcgctgagccagccgtctccattccccctcatcgcatgaaaaatgtcgacaatatcctcgttgtcgtttttccatatgctctccttgagagagctaagccactctgtaaacgactccgtgcaatctttcccagctattacatctttattccatagctcgatcatggcgctactcctggcgatgatgtgctccagtttctcgtttccctccaggagctcaacacgataactccgactttcgagcatctcttcaaagacctgtagattggccaatgggactctgaggtggtctatacgcgattccagatccgtgattgaataggaaagatcttccagtgtgacttcgaggaattcgtcaacttcgtcaatatgtccttgcaatatattgatgacttggttgttgtcgttggccattccgttgagcaatagatatacgccaaacgcgatttgggacactaatttaaggacttcgtgttgttcttgtccttttcgccatcgccaccgctctgcgtccttgaaacccttattttcctcccccataagaagttcatgacgcttctgtgcatcaagtggataaagtgcatcatccccgcgcagctttggctttgcctcgtcagagcccccctgggtggattcaagtaaagattcggcgaaggcatcttgcatcgacgggatcgggtgttcggggataggagggtcgtccggtgcttgatttaattgttgcatagctgcagagtcatcgtcgtcaggttccgggacttcagggatcgtgttgcgctgggactgggtgtgggagctggggatgccgttggtgctgtcgcgagagggaccattggcaataactgagacgcggaagccaccctcgtcgaaggtcaacggaggcagctggatcgaagtcatggttgcgacaggtcaagaggcggccgggatatattgactgctggtctgacagtgccaggaaccatcagacccagctagacgggaccgattggccaaaaaggaggcactgcacgcagccgacgttggacaagaaaagagctggaagaaaagcgcaggcgagctgtggcgtggtgtaacgagcggaagcagttggtttatggttgagcgaaaggcgctgccagatcccaaattcaaaggatggcatgcgccattgttcgacggatgggtcagggagtcggagcagctgtgacttgttattttgctaggaatcggctcgcccccccctcagagtcgagattcggttgtggcacacaccccagccaatctagtcagcagccagcgaggaacaggaattcggggggtgggcgtggaagcggatcagggatgcactgtcgaggtctgcagccaccaaaggggttgagagacgagaaataggcttcgtgacagctgcaggaccgcgaggcacaagaaaggggaaatgcgggagaagatggatggcagtgtgattgttccctttcccccctctctccgaagctggcggcaggagattgcactgggccgctggacagaaccagcggaaagggaggaggcgcctcgcgattctccgggggggtgcgcaggccccgttaggctaggaaggcgccactctcgtgcgcagtctagcgcaggtggatggcctgttgggttggtgctaggtgctgtgctgcagttggttattgtcactacattaccttccaaagtgcatccagtataattaattcccttactcctgacatttggcatgttccatcctgcctacaccaccttagcatcatactcacctgcaccagcacgccccttattccctcaattgcaacatccaagcttcgcgtctgtgccctacacctgcgacctccgtccgggcaccacacctctgaagacctcgcctgggcgagatgggtggtccatggatcgacccattggatacgcgtggtgctaacgggcattggcaggatggcattcgaatctaggcccacatggtgtgcccacggaaacacccctgcacccctgcaccccgtggtcgagcattgcagatggtcagttgtgcagcgaatggcgctgaccagacggccttgacgaacacatcaatctcgggcctggtcgtggtcgctcgcgatcggcatgcattgacagcggggttcgctcgcagtctagatttctgtcaagccttagctgcccaagctgcagcctcgagatcgaccgtccaaaatgttttcaaggtgagacagagcgtgtcgacatgtcttgggcgattctgtgcaggggacggcgatgcctaattcttcatcgacggggagggttgggatccaatggtcaaaaggcccctcccctgtgcattatccaagcgtacccatgagatgaaagggaagcaagggaaggtcaggaaaggtcaggacaggatccaacaagcacagaccagagcttccgtaatgatgggtggcaataactgccgctgatggtccagaatattgtccccaaagagtatggtagggtggtagcatacctacactctgtgcgtctgtttgattttggcgccacaaccctgttattaccaggtacagcaagatacttcgcggttcaatatttgtgagctatttgcacagggaaacacgtgagcgccgcgcaatacagacaccacgtactcccacagccccattggtagcaccagcatccattaattttagccgggccgccaatcggtccaggagacgacgacggccagagagccgacacaagatgagaattgatggagctctagacaaggaagtccccagcggccactggtatcccttaatctccacgggagtgacctcaggcccatccatctattttgacaacgcgtaatttatcggttcctgccacgtataataaatcgattagtatacatagcatttgagctacgaacgcaggtccgataatgccacgctcccagacccagtcagctgggctgcttctctcactggcagctgtcggccgttgactcatcggaactgttgatcacctaggccttggctcagtcttgggtcggagtctggactggatttttccttggcgcaggaatccaggcaagattcaaatacccttcctcgcaactgtcgatcaaggccgatccaacggtactggcaagcttatttcaaccagggcaaatcaggggcgaggtattttattcccgctttcctttctcagcactcgattgaagaagcgatcgacacagcatgaacagggcggctcagccctatattgatgatcgctcaaccagcactgccaagtcagggaaggtctgcagaggaggcttggtatttatttagtagtccgaactcaataaaggcccattcagccggctacttgacacttcccgcagcccctgagtggttgagtattttcaattcctggggagcactggagtacctagcagatgggatcattagcaccggtgcatcttcccataatgaccattgaggccgctaatactcaccaagccgcgatccttgtgtgcatccagctcgtttgctgacccaggaaaaagggccgcacattagtagggacaattagcgcacttgggctcctgccagcgtgctagaccgtgcctaagggaggtacctgcttgtacttacccctggctaatgggatcagcagggctattctccacatcccgccatgttccgtcctccgtcgcattcacggttcacactacggcagattaggagcacaggcttttccaaccagagttgagatcgctcgtgctggtcttgtcgacctcgcggtgcatatcacgaagaggcttcccgtggtggttccttggcagcattgttgactatagctgaccctatcagctctagcatgggcaatagcaggagagccacttgatgtgcagacgtcctttagacttccaataatgatgatataaactgtgtggaaagtgaagttgctgcaattatcaattatacatcgaggccagctctcgtgtaattacattggatcataggtacccgcggtactttccttgactggcaagattttgtcgaaaacgagggccgtacttgccagatcatcgtgaggaaggagcacaacgaggcgtcccgagagcctttcatcactgccaaatgacacagagggaaaacctccactgaaacatgttgatgcatcacttgttttccttgttttgcatcaatagtatcatatatcgatctcaattcttgagttgcttagagcgagggcatagcagagtgagcatctgtaacctccccagctgccttcgaaccaacccacctcatcatcgctcagccttcagtccaggccagctgtgttcttgatttactcgtatctcctcatgaagctagctcggatacgtggatgtctagccagattgcggtcagaatgggatcctacacatccattcgagacatcatggatccttagcccccgccgactcttcgcttgtcgcttcctactggtaggcgcaggccatattgttttccacgaacgcacgcacacagccgctaaccaagccatgaaaggccgtctacctgtggatactcagtatttggggctgcgttcgggctgccaagggtgctaagacaattaaagacgccatcacaaattgcttcaagttgtggccttggtccctcgtgatgtacttgagctgtgcagctttccacaccatacgataccatctcgactcgccctcgctactggatcaaccccatccgtttagccatgcgctgcattcgttctcatatacgatcgcaatcatgtcccctgttgaaatagtcgccgtatctctgttggatttgaccaacgggtcatggataaaacccagcttccgagactcgggctcattcaatcaatgggaagtgatcagcctttgcggcgtcgttcctatgatcggccttttcgagatacttgccccaaggaccaaccctatgccgtttgtgcatttactattcatcatgctgtttcaaatggtccggctcctccttgactacactgcgcttcacaaagaggtggtagttcacatggtcgtccctcatgccacagtccctattttcgtattctgtatcatgtggatgatgatttactcacgaaaacggcttaccgagcccaactacgatgacggcagtggtcaaactgagcctcgttctcctcggaaacggacacgagataccaagaccgaggtatgatggatggcattcacacaaggcagaccctattattccacggatcaagaatgttagtagctttaactttatgataatacagatatttctacaaagcttgatgaactacctatcctagcatttcgtcgtgaatcctttccggagctcttcctggcggatctcgaacatcacctggatacctacgaataggcatgaacatgccgtaaccaggaacatggcacctgcgagaaagcgttagaatcccggatattcgaggcagacagcccacggagtgcatgggcaaccacttaccagaccaatcatgcaagacgttcttgatgataacttcaaggccatcaagtcccacagcaaacccaacgagattagctgaaatcatcatgaggacgttgaaaatcgcgccagcgcagcaaagcatcctatactgcgtcggcttgtgctcccatttccttggggggaataaagcggtggcagcgaactcggggagcatgaacagaacaatcagccagccccagattaagagccgcatctgaatgtcatgccacaatgctacaaaggtaaatgaaagaagatatgttaagatggtgcgagcagtggatctccaggtccggaacgacgagcctcccagaggcacgtagatgtagcggatgagccagcggttgtaggagcggtgccaggcgcgccagaagagctgggtgctgtagttgttgctggggcagcggaccatgttctcgggggggtcgatgccgtcgacgagggaccagaggcggaacatgcgccaggggaggagaagcttcagccagatgatgtggagcttgaagaaggagaggaggctgagctgggcgggggtgtagctgctccagtcggggttgacgaggctgatgacgccgacgtagttgaagtgcagaatggcctccatggcgagcaggacgagcacgaagcggacggcgtagcggactgtacgccagccctcaatggtcgaggagcggtacttggcctgggagatgtagtcgttgaatgtgatgattgggccgaccaggtacagaggggcatacgcggcataccccacgtagttgcggaaggagtagtccctcgcatctgcaggtatagtgatcctgtcacgctctgagagctgggctgggttcaattgcttcttctttggtccattagcacagatcatggtggttcagaaagagaagggttgggttcttccatacctctatcgggctcgagccacgctggccgaggctccagtagtaatccagattgaagctgatcagcctcaggatggtcaggttgaacaggacttcccagcgggagatgaggccgccgtagctgtccagccacgcgccccatggttccagcgcaggggcgacgtgcctggcgatatcgtagtaatggtagccccggcagagctcattggagaacagcacggggatgttgaaggcccacgtggcgaacgggatgtacttccggggcagcttggtcgcgacctggtagttgagccagaagatcaggaggaccttgaaggccgagaagccgtggagcgcaacaaggtagagcagggcgaaggcgtagtcgtacgaggcgcgctgctcgaggcgggcggcgccgctctggcccttcttcgccgaggggtagacggcgtcccacaccctgcggaggagcgggtgcacgaggaggagggcggacatgtagggcaggttgcctcggaaggtgcggtattgggcatcggtgttgtcgaccttgcgtccgaacatccagccgtcggagaggtaccccgaatacttttcccatctcgggtcctcagctaggagtcaattgtgttagcatccagcggcggggggggtgtcttgtcttcagaggttgggttggcagacgtacgtccggagactgaatatgggacccagaacatgtacggcacggcgaagaggaagacgacgtagtagaagaagaactcgggtgtcttccatttcgacggctgtgcgcggctccgcgacttggctgcggcttcggtcttggcggcgggatcggatcgtgtgtcgatgacggtctggtagggagtcgtcgacgagacggagaagcgagtgtcgagagcatcgaggttgtagacgctcgtagcgaatgacagcaggcccatggtggctgcggtgtgtgggtggattaagcttgtggtcaaacacagctcatggtgtcgtccggatcttgggtacagacgacctttatgtatcgagagagtgtagtgtgtcgaagcgtgacgtgctgccgatttgaaagtgataaatgttgattcgtgtggggggtctcgcggttctggaaaatggtggatggacccctgattccaatcccgacccagtattaccccccaacaagccccctacctcatctggcgcagtcgagagatccttcattgtccattctttgcctcggggagtctaattcaattctatggcctgatacatgggttcgcctggctgattcattttaactcagcctctccgttctgatcccgactccgggtgaggcgcgacctgggatactcagcgtcataccgtacgatggatagagacgttatgaacagctctgtgcatcgttcggggttcaccccggtttaattgggaccgaggaaaggatctagaaggaaaaggggtgttctcttgggagcacgggtacactttccgattataaggttagttgaattgatacatagaattgacctttgcttgtgcatttgtacctcggcatgttgaagctgtactaaatatcagaaggcccctaaccacacattacacgagaaagtgaatgctctcgaataacatattccagtcaacatgagcaggtatttctagaattccaatcacgcgtctccaatcatttcacgcatcctcgacatctcttttcccgcttgaatgcgtaaatctcgtatctgatagcagttcgctacccctaaatatacatacacctttgtgtctaagccacaactacataccctgtagtcactaatgcgtgagagtgagaaccgtctgttttcgattcaggtcaagaaaaatagagtaatatcttatctcatcatagagattctgcataatatttaaaattgtattatgttcttagtctgaaatgtttgatcttgttatgcggaaagtaagaaaagcagatccactgcttgctggcatcgggagcaatcacagattgcgttatcccgacggggacttcaagtatctctatctaccgattttccgattcgctctcagaacaaggtgacaacgtcattcggccaattcagattacaaattctcttctagaatcgacaatctaatataggcttaaattctagctttttctccttgcagattcctcactgtatatacatattgccatgcatgttctttctaccctgaacgaagtagaatacggatgctaataaatagagaattcatgattagtacagcgtatattataatatgacaatatcgacttatttagctaaggtgatgccaaatagttgtgttcaaagtaatgtaggcagagtccgaatgtcagaacatggttaactcagtgccctaggcaggtattagaacatgagacccctcttcttcgtcttctctttgtattttcccctttatttactgggatgtcctatgatgaaacctactcttgtagtcttatgctaaatatatagtttcttagcgagaacgagattaaagtggactgagaattctacatagatctcgagtgatcatattggcgaaccaaaaaggttttcaatataggagtccgatgagattgtaatcttgattcgcagacaaacgcaatacacaatacgaaattattgatactgcatatttcgccccttgatcaaggcataacttaggctggacgcatatacacgatacttctcgccagtctcaaatatcacaaacattagaatttttgactttaacaacaaaaagaagaagaagagaagaaaaaaatgagagtttgggtattgacaatattattctagttgcaatcaagagacgttcacgcactaacattcttggaatggtgaattctctgttaacacataccgggactgatacatatactaagtggcccctgagattttttaatgtttattcaagtattagaaggccatctgggccagtaatgatctatccatgcatatccttggaaggatatgcggaagtgatataaattcgacatatacatctcatcgcttagatatcccttacaagtatacgtaacagaaaggaccatgaatagtgctcaacagatcgcgaatcttggtaggagttccaccagcgtagaagaagtcgacatagtcgtccagggtggtgttggcgctgggaggagagtcgaggaaggtgttcgtgccggagatggcgaactcgctgaagacgcgcttcttggggtcaagcatctgccagatccaccagacacgatcaagcatggagtggtgtaagtggaaagcgggatcgccgggagaggtgaagacgtcacggcctgggtcacctccgagggagtagtgaccgccgccgtggatgccaatggtgccggttccaggcttgccttgtatctgcaactggaagtcggcgacattctggggcttgaggatgttggagaggatggaggaggcattggaatagcggcggttgacctcggaactgagatcgcgtttgaggcagcgggggttgtatgaaaggggtccattggggttggtgattgtctcgccgccaggactatctagggaaatgggaccgagattcacactcatagatttgaagggacccgactgtacgcagccaccaccgtttcctgtagggagatgtattggggtaagtccgggttggtttttgccaaggatgatatcctcgcgggagccttcgtaagcgccatctccggacatggaagtgtcagaaccatcaaagatgggagagtttgtcaggccagtggcggcagtcttggcccagtcccagtactgtgcgcatttacgcaggtcaacttatctggagccagtggcaaggggctttaggtctcattggacatgtgcttagacttacaggctgtgtacccttgtagccacactcatttctgagcgcttcctcatacatccaggtgaagtaacggtgccatgtcaggaagttgcctgtatagtggatgttcaaggtctggttgatgtgagtggccacatagtcgtcgaagcgagtcttggcaccaggggcgacgtcggcgggagtcctggcaggcttgctctggagacacttgactgcgtcgatgtaggacttgcgttcctttttggatagggtgcccctgagaaaaccaaagtatcaaatcagcatttgtcagctcaaggggatccgggttgacctaccactctcttcgaatccgaatgttcttccaggagcaatggcttcttcgtttctctaaactggcttcattggcttgggcttgagcttcttggaaagcctgaccagctagaagagacatctcattactggcctggatgacctcggaagtggttggctgggcgagggctacagaggtgccttgtagcagtaggatagtcaagaatgaagtacgcatgatggtggtagacctagtaggtagcgtatttaatcacgaacgatctagaatgagaacgagagcaacaagaatggaagacctggtcccaaatgaggcgaaagctaagattttgagtgctagtaagtgctatatttacctacattgggctcaaagggacgcccccaacacgaacccacggccaaggaaacaaaccagtcttttgatcaatgaagaacagaacacttgctgatggtccttctgaggctgtatgctcgtggatccggttgttggttcgaataagcaggggtcaggcgctttaggtagcgcgtatcagatccccgattctttcattcatgcatctgatccggcacagttggaccaggatacgctctaccaacgtgttgttggccgcttttggatttatcatcgccactctgctctcctttcgcccctgagccgaggaagcgagcacgcagttggaaggtcatctcgaagcgaggtcacgaaagaacatcactgactcgaccagccatcccggccagtgtgataaagtagcagcccacctgcagaagtttgttccgatggtggatcgtatcgcatggactgctgcaatgctaccaaccaccaacttgctgtttgataattcgcaaggcatcttggtaagcgtggaagattgatattggcctaaatgtgtgatagtggtgtcctaatggatcgctgctgacagggagttgccctacgttgtagcgctaggagacttcttttcggtggctaagaccgctacagcttagcggcaccacacctatacgcccccctgaatcacatcacagcacctacctacatatgtgacctggaggtaattgaaggagccgatatcgcatccaccatccatcactcactcgttctgtgaagaatggcgagatggatcgtgagtttgactgacgagattaccccgaaatgctgatatcgagcttcgttgacttgtggcaatttgaagcaagccggcccctgatgaatcgcgatccacctcaaagcaaaatctatgagtgcagggcgggctgcgatcgatcgatgaacgttgcgtcgccaatctgaggcataatgcgatgtcgtattcctttttcccgccgccctcccccacgtggaccggttttctctcggttgatgaataaagcatagagtaagccagagctggaaggtatcattactgtgattattaccatggctcacattttgattcccgaatggacccggattgtggctctcaaagtgggtttggaggaaggaatatccatcttcatccatcttgggacgtgacaacttaagtctgtgtaatcaaacaacctgcctggatgcagaattttatgagcacaaagtggtgggtttccgggttggtgagagcctcaagaaattccttcggcacattcctaagaaactaatatgaactggtctagtcgcttgtttgcttttagtcttcccgaaggactgaaaacatgggatgacaggtaactaaaaccattcgcgtttagtccttccaagccccagttcacatgtgaagctagaatcaaaattgaatggtgaaatccaacagccgaaccccacagccggggagaataagcgctatatggcaagttcatgcccttgggcgatccagatcgcaggatgagttttgcttttggcccctcgaggaccttgagactcatcacttgcttcttggtaatatccagacgccagagaatgccttcctcgcgtatatctgcataaacccgtatatacagacatccgcattcggatcaatgcgcccacccgacatgggctcgttggcggcgctcccatcggcctttttgaggccattcatcggccgctcgttgccaagccggggactttggttgagcgaatatgatcgcccgcctttgcaaccgccatccttggccttgggatggagacgccaaggcagctctggcatcaattggccccttctggtggctatcacctgcatggctcgcttcgtgacttgcatattgcaaagcatcacggacgttgacgcccctggcaggcatcccagatccacttcccgtttcgaatggccttccttgcatcgtcgtcaatgcctctctaccaccttcgtctggtgtgtagagctctcattagctgctgccttctccacagcggtcaatggcacacacgactgtcctggcctctgacttcttcaagccgctaatgcgtgataggcaaattaggtgcccaacgcactgcattctgaatcgtggttgtccagcgtacatgtatgtacagatgttggtttggcagtctcggcgataggggccggtcggtagagaacagcgagatctggctggctctgttttgctgctactatttcccccagagccctctcgaaaatttccccatgatgttcgtctcttgctttccacaatatctgcgccccggtcgtagtgtgctgctacgatctattcatgtagtcggccatggcggaaaacctccagatgcctgctatttccaacccagacgagaatgcagggccgaggatcttaggggccgtcgcgacagtgacggccttggcttttatcctcgtcatcaagcggttttatgttcgaattgtaatgattcataatgttggttgggatgtgagtaattctgttttccgctggagtcacttttgcttgtggaattgaccgattgttggtataggacgccctcatggcccttacgatgatcacttctctagttggcttcggatttgttgttgctcaggtttaccatggtgctggtcagcacagaggagagttggatgacgcaacatattcgcgggggatgaagctcaatttcatcgctcaacccatttatttgtttgccatctgcttcgtgaaactgtctgtcggggcgtcgctgctcaggatagccactaccaagttctaccgttatctcatcctctttatcatgggattcatgttattttatactattggctgcttttttgtaagccggccgcctcgcattaccaggaattacccgtctcagccctggctaaccgctacttagaccattatcttccagtgtgccgatatccgtgtgatatgggacccagccgttccctccatttgttgggatacgaagacgctacaagctctgagttatctcaacgtttcattgaatgccgccaccgacctcctgttcgccgtcatcattcctacgccgatgctatggaagcttaacgtacaccgccgtacacggatcacactgataggaatccttggcttgggcgtttttgcctgtgccgctgcatttgtgaaggttgggtacctaatcaactacggaagaaatggagattttcgtgagttcgaactccaatcatcgtctacatgactccaagctgatatgctgcatcttagtttgggattctcgggatatcacgatctggacagcaacagagctgaatatcggaataattgccggctctctcccatgtctgcgtcctctctttagacggttcttgggtagcacatacggcaagcgctcactcaagagtgcgactacagcaactacccccgcacacggaacgatgaagggaagcaaatggaagtctttgggaagtagggtacagggcaagggtgacctacaaacaagcagccaagaagctatcaataccacgtttgctccggaggagttcgagctccatgaacgcgtcgggaaaggaaatagtcaggtctttacgaccgtggtggctaaccccgcgtcgacaagcgaaggcgatgctttgtcaagtccaaacagctccaggtcgagcggcgatgagcgggggataaaaaagacaatggttactactgtggattattctaaacccacctgattagccatgaggacggaaagaatcggaatgaagtacttgatacacgcccatcgacatactggtgaggcagaggtatgtatcaacttttggttccattaatgaagatgatcccaccttgaataaaatttagtaggctgtgctatgtagaagctaataagaaagcgaaagtggatgatgaagaaatttggaagtgtgtaagcttcatattcaagcctaaccgtacttctcgttttcttcagcccatctcggtctctagtttagtcaacatagtcaggcacgatccaaagcatacggttattacataatatcaaggatggaaatggactttggggtgagagatagtcttcactggtaacctctcatcttcaaatattcctcaaaaagctcgggactggcatttgcttctcttcacgatcctgattttcagatgaagtagaattatgtttcgatttattattcattaatatgtttcttatgatagcgtattggccccttgtatacgctagcatggagcattgtagatgatataggccccgccaaacatgttcagcctattcggcagggtatgagttcatcacaattgaatagtgccgcatcaaatttgcgccaatccttggtcacagccaccggcatcgtagggacgcagcgccggcgattcgcctgacgtctcttagtcaggaggagaatttggtagcatatcatacaatagttctctattccagccctggtagacccctttcttgaggaaaggtgcccattaatctgatttctaaaaaaaagccccgtcatcacaatttaaaatagtaaaattggactggcaaagcagatattgaaatccttacttgcatatcttgtagcgaatcagtctacttagcctcaaataccagactatgcggcgctgtgaaaaagtataagaaccataggacatgaaaatttgcatatttcttatgctttatacgtctgtagaactgaggggtgagactgggatgccagggcatacaaaaccgaatgagatctacgggtttgcccgtacttgggaagaagaagactcggcaagtcaacaacaccaaatttgtatgagctccctctttacttactctgagtggtgattcggatcatctaaagaccaagaagataccacaaatgtgaagcataagcaatgctggctgaaccaagtcggtctacactgtgagttcgcctcaaggacgctattaagatctaacctgatcagagagctaagaaaagagagaagatccactccaagtatcttatttaaagatggaccccagtgtaatgcaaggacttcctggggaatgcggctgatttcgctaaaaggcgctagacgaatgagtcgttgggtttagacaagctcggtagagtggaggattcatcatgaaaaggggagttcccgccattgacatccaatcatcgaattatccatctatcttactcaggttatgaagaaagttgttgaaggaagtttaaagactgacctctggggaaaaggggcttagactatccaagtgatgatatacaggttttggggcgtccatgctccatcataagcaaggctgcagcaattcaaggtccctgtgtgaatctagtatctattagcttggaatgcaaaacaccaaagtgaatcgagggcggaatatcaaaatgactggaattcagtaaacctatcttttcactcaataacttccggagcagaaaacgtactagaaggcatccgttcactcaatgttatgcaaccagcctgcaagagtgcattagtgtcagcaaaggaatgtacaatataagggcgcaatgtgaacccggcttagatgagcctattcgaagtttgagagcccggagggaaattccagtgttcataatgccttcttcggtgggatatccgcaaagcaagcgtaatcaacattagtcggactgcttgaagtctgtcgcggccgaaatattttggtatgtcccaaatttgaatcccgccaatagcggtagagtcagtcaagatggtttgagacttgatttacgtggaattcacaagagaagggaatacctggtaggatgatcaaaacgctttttgaactggtagtaatttctaatttctcctgaccccgtcatcctagctggtgggtgtcactggacatttaggggtggctgtggtgtcgagcgccaggtagtttgtctctaccttgctatcagctgatacggatcctcgtacaataatttaggggattctctagttcaaaggagaatagaagtacaaataatatgctcggtagtgttgtgtatcatctttgttctttcactacttgtgacagcctccttaagtatccaccgcaaatatcatcactgactcatcaacaaggaattacttgttcttcttaagaaaaggtcttttcaatataatttttgactttcccttgataaatattggttatttacctcccagctgccagggtagagtaaggggcttggctcgctttctccacaatacaacttagacaaagccatgttttctccatgctctttactctttcctactcttcagtgtggacaaatgaaaaacggacaaatgttacccatgctaaacggacggcaaccggatgcgtgacccgtggcccgcagcccgctagcgctcatccgaagaaagcctgatcaagggatgatagacaacgatcccaccctagtctatgttgaatgccacgtttgattgtgatatggacattcaattcacggattaaaaaggttgacttgtgcatattagctcaaacattcctgatcatggcttcgaggcccacacaacctgtttaaagcaggcacctaagaccggcactaagataggataatatgctcatgccatgaaactagtggaagctttctatggctcaatggacccttgtccaagctctttcgggtttaagaagaaggcctgtagaacaatccaagtatcaagcttccgtggaataaactctctccttgtgcactgccagcacaagagcagaaaagcctcgtgaacgagataattcaagctccctgccaatgttgaaaccttccttgaccttttttggaatctagtctacatgaagcaagggtttctttgattttgatttgcccaggtgatggcgggggaagtaatctggtgtacctcccgcaggactagtcgtaacatggccaccctaatgacgggcctgcactctttcctttgggcggtaaaagaaagccatacgcttggtgcatattgggaatcaagtattagatttgcgatatgatagtgtgcagttagaagatataagatgtcccagtctgtctatcctcgacctggtgtagttttactccccaccccttagtgaaatatcctccgaataagcacccaaatcgtactattcatcatgtctgaagaacagccccgtcgctctcgccgtctcgcctctaggggcgaagatccggccccaagttcaaacgccccatattctgaaggtgggcttcccgtacctccccacccctgggaacaaccaccccggatcccattggaaaccgacttgtactaactccttcgaaagacccttcagcgtttactgaaaatccagtggacgtgcctcaagttgcagcacgtccttagacccggccgcgcgttgacgacgatccgaatgaccttgacccgaatttgatagacccccaacttagggataacaaccaagagcctgagcctttacacgatgaaacatatgatacagccattcatctacaatttgaggaagccccgttaccctcgttggaggaattgaccgagatagtcaatgggcgttacatgtgcacgttctgtcttgagtgcgaacggaacgtatgtactcacattgatgaagaccgtcaccccccgtgtgggaaggcctttgaattaccctctaacgctaggtaagaactctccatgccctacaggcattgtgcattccgtctaatttcaattcctgtagaaaacacatccgtttgcacgtgaagccagtactttgccccctgtgtcaacatagatgccaaacacaaccaattatgagaaggcatctgaacacgcacttcaatgggaatgagggacaagcaagaccagaatgccatgtatgtgggattagttttactcgatcggacaactatgttcgacacatgcagaaacaacacccaaacaccgggacggacgaaacagactaatcctagccggatctacctcgcgccttgatgttggatattccttcctcatacaaccacgagcttagacatctatcgtagcgaagtcatcaaagcctaggagagagacttttatccgcagttatgtatttagtcgctcgtttgacttctctcgttaccgaggagattatatgattgaccttatacgctctttgacatcctgtgcactttttttctgtgaacatgtgggaaatcgtaagagataaaaattagctattgcctagacctgtcttagaatttaagagtccggatctgataaatagatacagtcaataatatgaacctttaccccggtctaggttctaagacgagataagcactatggactttcgtgactaccagtcaatcaatctctctagacttccatagtaagacttgagtaccattttccgtcatttttcgtctagcatatttgcctaccctatattccgttagagatgcatttattggcccctagctatgtatttctaaatcagactacatctattgagaaaaagaagaagattcaattaccctttgttcacaatctttggcttacatggatcgggctctggttcggattgtaaacaattccaataaagacgatccgtctctagtttgttcgtttcgaggcagcaagaattggaaacgaatttccattataacattaagaggctagtgagtacagcccagtcatatgtacgtacttttctggaatggcaaatattgttgattcgccgctctagtcttggaagaggaaattggttttagtcctatagaaggtttcccctaggagaggcaaattagtaaggcggcttttaggataaaaactcctaaattgaacttttgtgtggcttgattcttggcaatgggtcttctacgcaagtgaatgaagtaaacatcatgctctttcctcacgaatattgattgagagctttatggaactatccatcatagaagacaccagaaaccactaatactgaaaccaaaagaatctttctacaggcgaaacatatattgtaaggttcctaaatgatccattagaaatgtgtaaacaagtaaagaacttacatacatccatataagtagctgtttgtatcactaatttagccctctaaagcttagattgtacgctgatctgaagatcattccggcccaggtcctggatgctcgcctttccacagttactgagcgagttgtccatgtctgcaagcaagcatttcaacacgtgttcaacgccctgctgcccgtggacagcaaggccgtagacatatggccgaccgatgcacaccgccttggcaccaagcgccagagctttcaacacatcggatccggtacgaacaccactgtcgtagatgagcgtgagttgtgagttttgaaccctctcatctgcaccgatctctgctagcgcatctagagatgcgatggcgccgtcgagttgtcggccaccgtggtttgaaactatgattccatccattccataatcaatagctctgtgggcatcctcgacggattgtattcccttgagaacaatcgggccatcccacaaatccttgagcaccttgagatgctcccacttccgatatgtgcccgagtacatgacgtctagccaggtaatcgatttcttcataaggttggcattggtaagaattcttgcagccccgtacactgaacccggcctccacatgatcgaccacaactcagccaacttctgtgcgatgctgcgaggatcatcattttgcaatttctcatagtacttggtgaagactgggtcagagagaccgatctggcagccttcgccatagacaaagggtaggtaggatgtgtccagatccatcggcctccagccaatggtgaatgtgtccaaggtgacaaccagcactcgatagccagcagccttggcccggcccaagaggctggcagttatttcttcgcactgcggctttggccagtagagctggaaccagcgatctccatctgcatttgctgcagcgacctcctcgattgtcctggtggcggcggatgataggatcatgggaatgcccacattgtggcaggctctcgccgttgcctcctcggcatcgggatgcatgattttctggactccgatgggcgcgacgatgagcgggctcttgtaggtggtcccaaacaaggttgtgctcacatcccgtacggtggtgtcgaccagcatttggggccgaagacgataccgatcgaaggcggctttgttggcacggtctgtagtaccactgctggcattgccggctacgtatccaaagctcgtcggtggtactttgctctttgccaatgattcccactcggacggctttgtcgaaaataggggcgcccgaagagattgatagatttggcgttgaaatgatgcatagctggttggatcagggaccgcatatgtttgccccttggcgtctgctgaagcatcttgattcgccatcttgggaaacttaatacaaatgaatgccgcttcttagatcgagtatatgttccgagatgttgaggagtcgagcgatagtcacggaagggcccgcagctctgttggcggctaatataatcccaggttcggttggcggaaagtatagaaatccccgcgttggagcttgccgagggaatgaccttaaatggcaattaaacggcatggggctttcacgtgcgcttgctccttggaatcgatgtcagcaattaaaatatccttgtcaacggggattagttcatccataggtggatatcaccataaaaatcacattataattgactatccttggacttggtagaaaggggggtggggggccttggtaaaaggatattgcttgtctagctgaaaagaattgaggtgcgtgttgtatgtcttgttgtatgtcttgttatatgtccttgttgtggtttgaggaatgagacattgcgtagcagtataagtaggatttctgtacagaaaatgagaatagccgctaggatgccggagttctgagtaggagatgacagttagagttcttgagaaatacgaatctttgaagagggggcatcaatgccaaccgttgaaagttgaaggtaatatagctgttctcgatatgcgcagttacaacgctaatccatcggactatgtagctctgtttctatagaacttagcgactatctacactctgcatcggtcatccggatctttcttcagaaacgcgagcttaatgtacttgattatattaggtaattaaacaggttcagacagcactctgatgtaagctatatatctataaatcgctttcaccgttgcctattcaaacaacgctaggcttaattcagtccttctatagggtcctgagtgctgatgcgttcttctcttctgatctggggtaggctaacttgactaattcgctgttattagtagataatctgatgttatttcttaccacctgcgtgctgttatgttcatggtaatagtatcgctcttctcacaaaggttatataagctacatccattgggcaaccacctttggcgagaaataaactaggaagggcctacttactaagagttgaatgacaatacttagatatcctacagctgtctttgttaggactacataatcagggcatgacactatcaccaccaagtggaaagggatagttggaagccgatgtaagttgagacacgatagttcaagaagctagcacttatattatgatagccatgcctttttggctgtcttctatatctgcttatttctcgctatcatggaattttggcaacttgaaaagcttcttggcattgtcccttccaatcttcctcttgtccgcgtcattgatagcaagagcgtcataccaagtacatgcgtccgagaagttctcaaaggggtagtcgatagagaagaggattcggtcagcgccaacttctgtgagacagaactggagggtggatgttgagaagtggccgcttgtcgtgatccagatgtttctgtcaaagtattcgcggatagtcaacttgcagtcgagtccaagaggcttcttcacatcttcgaaccagtggttgatacgccacatgtcgaaggggatgtgctctccgaggtggccgagcacaatctgtagctttgggtggcgatcaaaggttccgtttgtaacctagcattgtcatcgtcaacattggccccaatgactacaatgtcatgatagggatctcaccatgccgaggacgtggaggctcacaccttgagcaaagctcagaggcgggccgatcagccatttacgcttcgcccacagcttgtcgtggatggagcctgtggggttgcgagggtgaagatagaatggcacatccagctcggttactgttgaccagaagacatcccactcaggtccgtcatagaaaatcatgtcatccccgtctgagccagcccgctgtgtgtcattgacctgcaatagacggttagcgggatattttaaaggccatggtttgagaatcacgtaccagtgcgcccttgaacccatacttggtgactgtgcgtctcaattcatcggctgcctccttgggatcgtgcatcgacaaagtcctgcaagttgtaatggttagaaacttcttttgttgattgattgatgctaattcttacgcgaaagcgcccaggcgatcagggtgctccttgatagcgccggcaatgtaatcgttcacttcgacggccaatgcttgagcttccttggggtcccatacgtcctgaacaccaggggctgtgtaagagaggatggtatatccaacgccatgctcatccatgtacttgatacgttggtttgtgacgtcggtgatctcagcagcatgcttgtcggggtcaacagcaaacagcgaagcccaccatctggtccgctcctggaatctgggcagggcaaatgcctcttcgagggctacttttccatacatggcgaaataattcaaatgaggttccaaagaataattggattaattgatgatcaggggaggaatgattcgcataccacttgaggaagctactcaagtaacttatagcttgtagattgcttacacatgcgaataggaatgactgcctgtccaaaagtactcatccggggctacgtagggtcttcccgctggtaacataatggctttgcaaacgtgatatccggttgggcgagaagcggcccgagatggctgcggctaatgcacctatagccaaatagcagatggcggctcgcaaccagaatggcccacgttacagcgcgctaccccttggaactgcgcctacacgcctcgtggtaggtaggtatgaaatttgaacagcccatatccgagctgcaattaggtcacctcgaaagggtagttgcccgacctgatgcctcacttcctcacttcaaggtggcctgctgaagcaactgcgcagttagggaccacccccgcatctccccgcattttgttcagacccctgtagctagccgtctcagcggccttagccactcacatcatgaaaaaggttctgatattggaagcacacactcatgatgagtataagatagaataatgtattaatcgcgtctaatatgccaccagaccgtgaagaaagcctgcaaattcctagcataaaagccttgcttggttgcaacgaaatgtcggtaccagaacaccgattgtttgatttcctccaacagcgggttcatattagatctcatgttagatctatgagagagaaaaatatgcaaagcgaaaatctctttatgaatatgccttattattcgtcatgcctcatctcatattcacgtgttgttggccaatccataacccgatggtcccaatccgtcacgacattctaccaatacagaatcatgggcattaaaacttccaaaccaatgttacttcttttatttaaataaattgataatgctaaaacaagaaatcctttgactatgctccaatagtgacaccgttgggaagctctaacccgatgggaaggccacagacaaacttggccatgaatttctggcccctcaccttagccagcttctcctcaatatctctgtacatatcatatctgcaaataacaaaagtcagcaacaagtcgcaggattaggtcaaggttccgagtcccggccaaacttacgcgttcatctcttcaatcgtcaacaccttcttctggtcctcaacctggtatgtaggacagtccttgttgaaggaaaagcctgtgagagatgtcttagtaactgcttagattgcccaccacgcttgctattgtttaaaacttaccgattctctcgttgatgttgtaggcagccttggcggcggcggcctgaacacgagtggcccgaggcaggcgaacctggtcgtacacggccaaggcctcagccacgtcgccgttgaagtacttcttgttgaacaggatcccgagggctgcagcgtcctcgatcgccatgcaggcgccctggctctggtggggcatcatcgggtgcccggcgtctcccagcaggcagaccttgtccttgtgaatataaggataagggtcgtggatccagagacgccatggctggatctccgtcccgatctccaggtgcttgaagacctgcctgtcgagctgcgggtaagggttcaggagctcctccagaggacggtcctcggtgccccacgcctggttcgagtagtctccctgatctcgggggaagaagcagtagtaggagaggagcttgccgccgttgcagggggagaggacgatcttatcccacttgccctcctggccaccccagtactccagggcggcgtcctcggagtagtcaaccagaccggccttgacggcgtcttcggtcctgacgttgcagtgaaggcagctctgctcggctggcctctttgctgggtgaacaccgatgattcttcggacagccgagccgataccatcagccccgacgatgagatcgtgccttgcagtgactccgttgtcaaaggtaatgatgttcgttgatagatcgatttcgcgacactaaaatgaccgattagcattataatccccacgtttcaaaggccatgtgcttcgaccaaccttgtggttcaccaacagcttcgcaggctggccctcgccctcccccatggcagtgtccttgagcatcgagtgcatgtactgccggtggaacatgttatacacgtacccccacctctcctcgtagtccgccaggtcgtagacgctgacaggctcgccagtcttccagtcgcggttgatcagcttcttcagcacgaccgggtcgcccttggccacgtcgacattccactcgtggagccaccgcgtcccgttggcggcgcaggagaccgaggcgcccacctcgcccgcgtagtcggatctctcgtagatggttacttcgtggccggcgcggcggagggcgatggcgacggacatgccgccgatgccaccaccgacgacgccaacgctgagaggtctccaagacatttttatttgtgatttggttgttaggatggggagaagttattctagacttggaggtttagcataaagagatgatgaatgattgatatctttggtgtgtagagcaaactgaatgtaggctcatgtgggagcagaacactcatatatcttcgatgccgtgaagcattttcgccgtcatcacccacccaccagcttaacgccacccatcatcttccagagataagaacatctccggcccaagaacatatccgcatgctattatcgctaaggaggaggtgggcaagttggtgttgtcgataggtcgtctcatgagccagttcatatccgctagttccggataatgcaccagcgcaataccgtgagctccgacgcatcttcaaccattcaacgatacggtttggatcatcgatcgtacgaaagtgtgagaaacccctattaattcggtataaacacaggttgcggcccgcagtaagaatgatgaaacgcgtatccataatgtggttcattatcaattaagatcaagttcagaaacatcagtagctagattattcatacaaaacacgaccgaaagccttgatacatattcctcttccattaaccagctagacaaagggaaaactgtcccactgagaaatattcaggctctcccaatccaggttgagctcaccgctgtctatttcagggaacgaccaattggtgtcttccaggcgaggtgtgccgaacagggtttggtttgaataaatctcctcgtcttggggctgcgcttctgggttcgccggcgaggatgccaggctgaagagcttggaaacatatcggctcttcctagcgccaggttcgctcgcccgtcttctggagatagcgctcgacagagacgagagaatttccagataatgagctgcctgggggctctgcacagataaaaactccagtacttctttggagccgtggaaagccccttcgatctcctcctccaccgatctcttggcaaaaactttgaatccaagaaccaatccagcggcaaatataagggccctaagagatattgttagatatgagtagtcaataaacggaaggaggggagacttacttcatgatacacatgtttccctgaagcaggccagcgttgagtgcttcaagacatgtttgggataggtacattgccgcctcaaggcaggccgtggccagctgagatggaacattttcgttcggcgactgcgacgcaagggttgacatcaaaatgggccgggttactagcgtaactgcaaaatagtagaggcatgaaatgtgcatcttggcgatgacaccgctttgcatggctccagactgttgatcttctgtcaagctcataccaccgacagacttcggtaaatcccttttccagcgatcaattgcctggagaaggttctcaatgacggaagttgtgatctccttttgatcatagatcttgtctttgacttcattgatgatggtcacaatgttatttgatgctactagccagtctgtagtgttctcgagaggctcgttgacgtctttgagaagggactcgctgtttgaatcgattctggcagtggtagaaggtcgtccgaggatcgaattgacgagcttgtcgaggacgcatatgctcaaccatacgcggagtctacatgagcaagtaagatctctgatgtgaaaagtattcatcgaatttcatgaaacctaccttaccacgtccatgggccctggcttctgcccaaaggatgctcgactatgtaacccaagcgccaaagccgccttcacagcgacgcccaggtacatgaacgccgaattccttctgcattcaccgagcatataaaaggccataagcagaaaaatcctggccatgtctagatcagggtcctcaaggaacgaagcgaaagcgcgctcacgtgccttggcaaagtaccattggcctaccgaccgtgcggttgagggagattcagactgggcgccaatggcaatgacaagatcgactgcggcttgtcttagaggatgcttcgttctcgaatccttattagtcccctgaccattggattttatcaattcttcgagatgtgtcgagtcaaatacgtggaggaaaccttctgtctgtgggtgtgttagtgagtcggccgtatactggtcgcaagtcccttaccactgcgtaatagcatctcatgtattttaatctctgctcctccgacaattcaggatcacggatatctggctcagcgtccctgatggctctgggagactcgacttcgagcattgtctcgctcttttcattgtgtgagaatggcgagggcccaatttgctctgccaccaaccctcgcaccgtttgaagaaaggatattgacgcagcaccgccgatgaagactagaagatgatcaagttagtacataatcacttcgaatggcatgcgctaccacagtacctctctcgccacgaaggttcaatagcattcgcgacgtttgaacaatggagggagatgccccggcatcggagtcagggcgagaatcagacggcgataagggctgaaagtttgacgaaccgaccagcgacagtcttctctgcgaggcctggttgggagagtcggtctcgtctccttccgacgaggctacaacacctgcagatgcggcggaaaccgacatcctctgtggaaactgcgatgaggagtcggtcgcggcgtcaagctgccttctcgcccttgctctggagccacggggcgcatatgtgacatagcattgctgggcaagtccacggcggaggcattgagtacatggcggcgagccagtgcaccgcctcttggtttcgcggcaatggttacaagcctcagccactcgctgtcgctggtgcgccgggacctttggacgaggcattcttacagacaagacagaacatcactggtgaggcaaaaagagatagatggacgatgacatgcgactaggggagatcgatgaaggggcaagaatgaggtctgctcatgtccgataagcgaaccctgataagcaagagcacaccgagatgccgattcacaccaagatacaagttacactcgttagtcggcaatctttggttatctgccatttgtcaatccacttggctgattggcctccagcttccccgcattcgatcggggaccgtcagtcctggttaggcaccttgaaccaggagtcatgcagataccaaaaatcccggatcctggatggctacatgttatctctagacgtggtggggtgtcatccaccacaccagacgtcttatcatgaacttgcggctatgttcctcgttttagttcggtgccgctggttatcatcgggcgtcggataatgcacccggacggcagcggctatccccacttgcaccttatcacttcaatccataacatcaaccttcctcgttaacttccttgttaagccaaagagagataagcacgcggagagacattaaaaaaacccgcaggtaagcttgatacaccataaaatgcaaatgaatcatgagtcttcgtcattcagaccgtgctattcagacccagccaagcttcgcaaagctggttcaaacttcaccacttagtttcttcacaactttaaatctagaagtcttttatggaatacaaatatattagctctacctttgttgataaaatgttagccactagacttttcagagcgagggccagtcaataagcgctcgtgtttattctatcaaatctcagcgatccaactcgtttgttgactctttgattgacatattagggcttgtgtaaagagtctgtactactatggttaatatctgcgtattgtggtaaatttagcggtatcatagctagatggaagcttatgggaaaggctcaagcaggaagaggtgttcggtgaacactcatccataaatcctcttccatcacatcagcatgggcgtattccacacgcaaaagcgaactcgtagtttagaaacgaatctcaagtcaaacataattgctatagtttcaataatcaatctgatattaaatttaaggagaggggtcggcgcttagcaccgttgaacaaagggaacccatctagtaacatctctaaggaaaggaataagcgccaaatatcgctaaacaaaggaaatccaccgggtatcaatctctaaagaaaggaatcagcgctagacgtcgctaaacaaaggaaaataaaatggccatcgcggctaaaaaaaaaagaaggacacgccatccaaggcgcgacaaaatcaaatcatgtggagcatccgcgccgtcaagcgccgtagactgttcctgctcgtcgtgctgctatttctgctgatcggtcctctgggtttgcgaggctcctggcttctgcgctcgctggatgtgggatgtacaggactgctcgtaccacttgatccctctgctctggctacaacagaattgtagaatgccggtatcgggtcgctttctagcgacccttgaggccttacatgggaaatggggtgttggtaaaagcttttgcgctgtcgttcctgaaattcttggaagtctttgagaagcagatactgtgcgtccgtgacctgcacccatcgtgacggcatgccatcttcctcggggggagactctgccatggggtccatacgtggtgcatcaacgacttcgtcttcgggctcgggcaggctcaccacctcaggagtggtcgcctccgtgtttatccaagagaatggccttcctacggctacagcctcgactcggtggcgtggagtctcccttatcttgggcccatcagagggtggctgcgtgggaaactcgggacttcgatcccactctcctctcgggtggtcatcggggggtttgttatgccagtggacctcgtcacgcggccgccctgctcttagctttttcaccctgtccatgcgcttcaacggcgtgttgaagcgttgctcaagttcttgcgcagcattaaagtagccaccattctgttggtattcaggcggactgcagcttggtacgccgaactgctcctggtatgaaaagcttggagggcatgggccctggtagcgaggcccggggggctcgcgggaggtattcatggtatgtatgaacgggtggccagtcatcttcctgtttttcttgagttgtttcgttttcgttgaaatggaattcgcaatatgagtgacgaaacttcagagcaatccgatcgggatacgttgaagagaagagattcggcaagttccaggcctcgcagtaggaaaaatttatacctagaggggatctgggttgaacacttggtcaagagaccctccacgcatcatgtgtatgcagtcctgtttatgagcacggaaatctcccttctctcccaatcaaaacgcatcgcacagccttgccacaaaccaaataactcgtttatacagctccacaatgtggaaacgggctgtcaactatgcacgccagacggtcaaagcagacccagagaaagcatggacaacgctcaacgtctcttcattgtcatccatcgagtggcataacacctcactcttggcacgcgggttggtagcaagacgtggctacctgggtggtagagatgtggttacttgggtggcagacatgtgattacttaggtggtagagatagacggaccttcatccgagtctgatgtattgagtaattgcgaccctagtggattctttcgtgacacgagtcaagatgacatgttgagttttgcggaatcaaagacattaacgatcctcttgggactgcttcacccccgatccaggccgtaccgttttccatgatcctatttaatccgttgttgcaatcctcgtgtgaagaggatgcaatcaactacattaagcgcctccctctttccagggtatccaacgttatccatgttcccttaaattcagtatctgccgagatggggtctcggtgttcaaagcttcgtaaacagacacttattgtccatatctgactgatagtcgccgccccaagttacccaaaaagagaagaaatagagagaaaaaactacaataaataaaaaaaagatgggtagcaagtaccagaactccattttagcaccaactccgacgctgagattccaaccaataattccacttcatgcgaactggggaaagagagagtgagagagaagtgctcgagcaacaataagggatatatataaaaacatgctctgggtggattaatatgtgaaatcaacatgcgccattactggttgggctttgtcctgacttgatgaggagccgttgttcgtctcgctattttgagtagctccggaagattcagtgtctcccagggttgtgtcggcgctagtttgtgatgttgtcgattggagttcgtgaggtgcagtggtctgcgcacccgtcgtcagtccttcgtggacgatttgttggaagctccaattgggctcaaaattcttgctgttccaggcatggtcaatgcgctcatacatctcatcaatctgttcgagagacattttactcgtctcgtacaccatgctccaaacaaagaaaacagacagtatgcaaaaagcaccccagataaagaaaatctttggcccaaagtctgcataacgtggggcagttcccaccataaagggggtactgtaggcgattccgaagttgaagagccaattcgacgctgttgaaacagaaatggccttggcacgaatcttaagggggtaaatttccgaggtaaccacccaggcaacgggaccccatgaagcggcgaagaaaaagatatttatcgcacagaacaccacgaggatcagctgtgcagcctcttgtaaatcgtggcctgcggcggtagagaatgtggcgatgaagagctggcaagtggccatcccgatagctccaatcatcaacaacttgcgtcgaccccaagtttcaatcactaacaatccaggaatggtcgcaacaacgttgataacgttgttaatgagcgatttggtgtatgggctctggacgccagcgccatcgtagaaggtcgtgctgtaatacatgatgaagttgatgccggaaagctgttgcaggatctgggtggtgcagccagtaatagtacgacgaccgagatgcggcgttccgaataacaggtctttgtaactattggaacccagagataattcgtatgcatggttggccttgatttccgctagttcttcaacgaggactgggtgggtgatatccaagcgtcgtagtcggctcagagaaatgccagccagttcgtattctcccttcatcaccaaataccgaggtgtttccgggagaaacatgagaccgccagtgaggatgagagcggggaaaagctgaagtcccaggggaatccggtaggcggaagagtctttcatttcagccgtaatgacgtttacaatggatgccgataatagtccaatcgtgatcgagagttgatatgcacagacaagagttcctcttatccatctaggggccatttcggattgatataacgggacgagcacggagatcattcctacaccaactccagcaaggaacctgtgaccctgagtcagcatcccgcttcccaagcaagaatgaaatttccacttcacaacgaggcgagcgttaccttcccacgagcatcagaggtgttgcctgggcgcaaacttggcagatagcaccagcacaaaatattccaacagctatcaggagagtccgacggcggccaatattgtcgccggcgggtgcggcaagtagtgcaccgacagcggtaccagcgctgagaatcgcgacaattatcgatgaatcttcggggcaaatatcgagctggtttttactgtcgtaacagttggttccgaattggtctttgaatgcacgcatagccagaatcccattgatcgcgctgtaagaaaagggtgtcagccgaattgcccctgcccattcaagcaatcacgaagcggaggttgatttttcgttccacacagaccacccctccgcgaatgcagaaaaatgtgtggaattatgttccgtctgattttccattatttttccatcgcatgttgtgtttttcccgagtccagtccatctggtttcaattgggcgtcgattcgtagtgggttggtcatgtcttcgagtctcgagtccaagcccgatggattggaggcagccgcagaaccgtcgagacgagggcgggcatggagataaaatggtaggttgcaaatgaacttacccagtatcgtatccaaaaagtatgcctcccgtggcaacgaagaggcctaccatgatggccggcgctgacgtgcctgcgacattgtcaggcttctgccagcccatggcaatcgccatggtgtcggggtttcggacgtcaatccacggttcggtgaggggaagatcgttcggaggaagtcgatgtttcgtttatcggcggtgacgcgggagcgatgcaagcgtcgtggtcgccgtgtcgtcgtcggtgaagcaaatgcgttgattgatgtggtgtgaggtgaaggagaatggcagggcagccagtggagaagggcggtcgcaaaaagcgggtggtggacggaggtctaggcagggaggcaatgtaactcccattagtgacttgcttggcatggggagggcgctgtgcatcgcatgggcgggttacgttgggggaggaaagagggggatcaggatcatcagggtaccggccacccactagacaggacgcttagcgctcgtcggttgcctgaggtcgagtgctgtgcaggaactagcacccgctagacgagatacaacgagacagagaggtaccagcggccctgggaagcacgcctcggcagattccttgaacgctacgggcaaggaagaagaaaaaataagacggcaagaaattacccaaggccggggcggttcagctcgggcagacgcgcaactgactaacgactaacaggctggctgggttggctgcacctgatctcgctctagcacgacgttgactcttacgtgcacaaatggagagcgctgggactcgaggcacttgtgggacgaagcacatgcgcatgcatccagtccagtacatgagagagatttcgagaagttggccgtagtgccaaggaccaacagcgacgacgatcgataccggagcgggcgagggaaggaatctggcagtgaaatcaagaaggaaacggggccagggaagggggagcagcgaggaaccagacgagctggggcagaaaactggacagcgatctgcaggccggcgggctgccattggctggatgtacggcgccccagcttcgaagggcctgaatctgcgccatgccgcatccagcgatggcagcatcgttaaagttgtacgtggagtagcggcttcttccccagatcttgtccctgtagtgtagccttctcgtcgtgaacgaaattaggcggtatggcagacacggacacatgatgcgctgcgatgccgcgcatcctggccaccacatggtccatctcgccggttgttagtgggcgacgggtccttccggtgctgacaagaggccatttcacgctgcaaatgcttcctcctgcccgcggatgccgtccaagtacccccctccatcggccagagtcacagtccccgctcgctgtcccagatggacccatcccaatgggtagatttccctctgcgcagagctgagcttcctcccctttcaatcctgccaggtcggcttatcagcacagtcagccgcaggcaaaacagcgcccagtcccttgactcagaatctgggagccacaattacggcctttgtacgccgacccgacattacacagcgaaccagcgagacttgtcattcgagcgcaacctctgcccgctggaagcagtaataatcatgacacaccctcaccaccccgtccgtccacccatcctatcgcacccgccctagccgtctagtctcctgtgcgctgctttgttcgctctttaccctcgccaagccgccagattccgaccaggggccaacgcttgattgcagtcaatggacacaatggaggtagctttcccgctaccatcgccctaagagcaacccaacgcatgtgagtgtctcgcgcctcgtagggctctgcgacctgggaggattgttccatcatcgtctagacctgtggtcaagcgcgtatctcgcttttgggctggcgcaggacggggcaatagtcggcacatcaccacccgcggtcccccctccgcctttccccctctgtccaaatctaggagattgtttcatttgcaagccttcgcaccataattaggattgttccccctggctaccgatgaccggaggtaccgactggggatggaccatgccgttgcttgcgaactactaatgcccactattatgccctaccctatggtccacgtcacttgctctgccacaggggtcgcacaagttggctgcctcaagaacacctgcatggagaggttcaatcacgacggctagcgcatgcgtggcttctgctaaggagcctacagtcatgcccatcgtatgactagcgagcgttctacccatcccatcgatcggtaaaaccgccgtggatgccatcgccaagtccgcccggcattggtgcggcatgtcgtcttgtctactaacactaggcagccgcataataaaacaacctgtagccatgaccccaatgtgcccacgtccctcgctcccttgcccagctcatcatactccgattacttgtttcagccatattgcccaacacccgcgccgtccttgatagtgttggcccgggaggtcttggtttcccgctctagaccagaccctcggaccgcgcaccagccacgcccgtactcgcaccatcatctgtaggcaggccaatgctgcgcttgaactcacgcagccacacagcgttgtctgccggcgtttggttccatgggtcgtcactagagggacacggctgcggttagcggactctccacttccaagcgtgaaccttaccaaagccaacgtcaaaagtactgagcaaaagggcaatgggtcaacgtactcatcatacacgatccatcgagcttgatgcctcagctcctcgtccgttgggacatggcgcttcgggttgtgcgacgacactgacgcggccacgaatcgagacagatcctttgacaggcgcaggtaggaattctcgccactgaggaagaagggcatcgacgtcaaccacacgtcgtcgtcatggcctgctatctgctcctctgggcgggacttggctctccctggcgacggtttgggggtcttacgaggcgcgcttgagccatctgatggtagcctcacttggctgtgagactcgaaatgattcaggcgcagatcttccgcgccaggtctcgcacttgtgggcatcacgagcggcattgggccaagctcgaggctgttcaggccctcgtccattacgagggcctcggaacgggctctgaacgggtcgatccacctacttgatccgagaatagctctctgtagaaaatgtttgaagatgttggagggcgccggtgagagcgtctccgcgttctcaacgatgctacatgcctccttttgtagggactcgtcttcgagatccaggttttggcttttctgctgctgtacgaaatttcgtaagtgtaattctagaaggcagtcctggaatatcgttgctttcccagcgattttcaggggggtaagccgcgacttctgcttgcctttgactagtcgagtctgggctcttcgagaaatctcatctgaggagagaaaaagatcccgaagccatgatgcagaggaagacacgagttcatctggtatcaagaggtctgaatcgaatatcacacagcacccctggtatagtagttcttcgtccgctggcatcgagccatttccatcaaggtaatctagtatgaagtactggatttcggctttgagtagttcgtatgcgcttgtcggagactcaggcgaccctttggcggcggtaaatggataaggcgatgcgctctcgagatgaatcagatctgttcatcaaattagatgagtcttagtctcaaagcaaacatggtagagacaattcaacttacagggaggcatcgcattctcaactatctctagtacatgcggctcaaatccccagtcccccttccagtccgccatagtcttcccctctcgtttgaaatgcctagtcaggtggtcaactcgatcctcccaggagaacagcacggcatcgcagaagccgcagcgcgactggatttgatttgcttccttcttccagccctccatcggccatggcatgaactttgacccgtggactagtcttaggtgctgctgcaagtggtcttttcggtggaacgtccgctcctctgaagacctcccgaagcaggcagcatagttatggcccgttagatgctgttcgtccgggctctccaatccgcagtagacgcaagatgccacaacttgcccaggccgaatagccaccggccctgcaggagagcatacccagctatcaagagatatatgcatagatttctcatgccgtctccagtcatacttggtcttgaaggagtcggtacagaatgtgcatgcaaacatattccgagatggaaccagcactgtccgatgaccctccatttgcaaggcgtcttgccgtttccgccgacgccggcgccgtgaagcgcccacaggtgaattcaacgatgacccgagcgagcctcgtgaggaaccagatataacagagccttgacttgaacgtgaattggcactaccaccgatggaagagccgtggtcgaaagaccgcactgactcatcctccccagataaaaatgagccgctgcttttaatactcgtactatatagaccgaaagactccctcacggcgcgagcaatactgctcacatcggctggctcagcctccggaggagagtgttcccaacgctgtaaagggttcatatgctcaaatggagccggtgttggggcccgcggacgtcttgggatagtaagagagccgattctttcttctgtatttggcagaggagcctgggcaggctgaaatctggttcttttccttgcatttgcgaaccacgtgctgatctggcgctttgtgaggccggtttgcgattgcagccgccgcagatcctggctacctggatagggattatctagatgatcgctcatccagtttctaagggccttgacggacatcgcggagaaccttacagagcgttgtttatcctccttggctaactgccgaggcatctcgtcaattgatgtcaagtttagcggtgtcagcagtgtgtttgtagtgtcaatttcagatgactcgttttgtcctccttcgctttcattgttagattttactgggccagacgagcttctagatatcaggtgtaatgcctctgtggtagtgtctgtttgattcctccctggcgtgtcacgaccttctcgggtcccgaagcccaagagggttatatcttcgattgatccaggatagggagcatgattaccagttgaagaagtttcttctaggtactggtccccgaagtcgaaggaaacgcagtccgagaggtctaagccaaaaatgtctgagggatgcccatcggatccatcccaggtgaagtcgtcagccatagcaggagagaaagagcagatattcactcaaggcaggaccaggggtgatcgatttggcgatcgtcttcacatggctctagaagcagggcacgtttaatgcaataatgaaacaagggcgtgatccatttcccaaaactttacgccggatgtaaagatacgcccttggatgatgagcttcttttgcatactgtgtgttagcgggtccgcagccaattttatgtggttggaagatgatggtacagtgcttttccatttctcacacactcacccaatcatcatgattggcggagttatgacgccaatcatatcgaccacgatgtttatgactttctctagcgaataggaccatgggtatttgaatccttggattcaactttgcataaattgcagaacgcctctcgaggccgccaaagcctttgtaacgcttcgataatctcattgctcaggctcagccattttctccccaatatcacagcaattacaatgctttcacccatcaattgtctgagggcaaagactcgcttctccagtcctaggaaattctccaccactcgccagtgcctcacacagttagagatcaattctgagcggctccaggagactctccactacacttgtcaatggggagccgccaatcgatatggagagtatgaagccaatacgcaggggaacaaatttgagcttccaacgttgacattgttaattttaggaagcccaatgagaccggaatgagccgcctggcgctctcggacgaagatgcacaagtcaggcgctggttccaccaggaaacagaacgcctcgggtgtaaagttaccattgaccagatgggcaatatgttcgcccggcggccaggtgccctgcgttcttgtgccccaatgacagctatggggagtcatcttgatacccagcctcgaggcgggagatatgatggtatcctgggagtggtagccgccgtcgaagttctccgaacaatggaagagaacggataccagacacagtatgatgtcggtatcattaactggacaaagtttgtgacacttgcttctttctcatcccacgtagcaccctgttgcacctcattcacttttgttgtcttcgcggattgtggcacattggtaactgacgtttgatcgtattagtgaggaaggagcacggtttccgaaatcgatggtctcctcagccgtttgggcgggagatattccaattgaaaaagcctgggccctccaagatatctccgatccctccgttacaatgaagagcgaactggaacggcatggatatcttggggaagtagcatgttcttctgatccggtggatgggtacccgttgggggcacatttcgaactgcacatcgagcaaggccccatattggagcagacggcgaagaaaatcggcgtcgtgactggaactcagggttaccgctggtttactttcactctcacaggtcggaatgcccacacaggaaccactccctttgaaatgaggagggacccattgcttgccgcttcgaaaatgatcgcctcatcaaacgccattgccaaaaagtttggcggcctcgcttccacggggatattgaagatgccaatcgactcttctacaaacacagtcccatcagaggtcagcttctcgcttgatattcgacaccccgacgatcgcgtggtcgcagcgatagaacagagttgcttgcagtcgtttcgagatatcgctcaagaggatggcgctggagttgatatctcatggactctcgacacggactcccctgcagccgtgtttaacaagcagtgcatttcagctgtagaacaagcggcaagctctttagtcgggcctgatggctggcttcacattgcgagcggagctggccacgacagtgtgggcacgagtaagcgctgcccgaccacgatgatatttgttccctgcaaggatggggtcagccatcatcctgaagagtattgcagccaagaggactggtatgtggcgccgcgaaagtgtcaacctacagatagccaaggctaacgtctctttatttgtgcagtgccatcggaacacaagtgctccttgattctatcatcatctacgatggattcagggaaaatcgagttgagctaccagcgagggtgtacatatagatttacctgttattgaaataactccaaccatttgggaataaatccaagcctccattttcaatctaactcttcgagccggaacatgggatagatcagtagcatcagatcaacgacaggtttgggggtttaaccctgacgaacttcatttccaagttcaatggagcgaatatgaagggaacagatattgtttcccaatattgaagcatgttttcccgctggggccctgctatcgacatttatattcataagatgtccgttgcctatctaccgcccctctgcacatgccgtacagtcttttccacataatttgatcgcctcagcagcttgtatggattcaatacagttcctttctcagcactggtcgcttctctcaacagcgattctgcacaactctagtaaatcgtctctttccatctcctggatcttctccccacggtaaagatcgctcgatatcagcattgcccgaatctcatcgcctctctcctccagcagcagctttagattccaagaagaacgcaatgctgctattgtattttcttcaggtgtgattggaagatcatcgactctcttctctagcagcaactttagatcttcagaagagccatatgcttctgttgctgccataaacggctcatacgtaagcctcccatcgccactcttctctcgcagtacctttagtttctcagaagaaccccatgctgctacagctgctgctacaaccacctcaggcgtgatctgaatctcatcacctcccttatctagtagcagctttaggctctcagaagggccccatgctgctgttactgtaaccaccttaggcgtgattaggatctcatcgcctctcttctctaggagcagctttagattctcagaagatccccacgctgctactgctgctgctgtaaccacctcaggcgtgatctgaatctcgtcacctctcttctctagcagcagctttagattctcaggagatctccatgctgctgctgtaagtacctcaggcgtgatctgaatctcatcgcctctcttctctagcagaaactcaagcaacttcatgccattctgatcccctgctgccgctatgagtacctcaggcgtgctttggatctcatttcctctctcatccagcagaagctcgaccgtctccttcgcacgaaagccgttgactgccgctgtaactacctcaggcgtgattcggatctcgtcgcctctcttctccagcagcagctttagattctcaggagaacgccctgctgctgctgcaaccgcctcaggcgtgatctggaactcatcgcctctcttctccagcagcagcttgagattctcagaagaactccctgttgctgttgctgcaaccacctcaggcgtgatttggaactcattgcctctcttctctagcagaaactcgagcacctccaccgtctttcctgccactgttgtaattaactcaggcgtgattggaatctcatcacctctcttctccagcagcagttttagagtcccataaggactccttgctgctgctgtaaccaccttgggcgtgatctgaaattctggcattatgtcattttgcaatacatggctgagcacctttggtgcatacacagcaatttgaaccaggctctcttcagtgaattggtgtgaaagctcgggaacacttggatccttcagtccacttgcaagccatccaatatcaaaataaacacagatgtcgaatattgacgagttacggtaccagagtttcgtctcatgcgcccgtctccagtgctcatggtttgaacccataaaaatgctttgaaccaggtcgatgctgtctttcacatcatcaatgctttctatgtgttcataccaatatgttgcggcgtatccaaggaaggtagcctcttctttgtcggaacaatcttcctcaactgagattttatcttttcgaatgttgatatctccaaagctcaagtatctcatacacgttctccctagtgcgagattcggtcgcggaagctgcaattccaaatctccttcatgccatattgtaggtcgagttttgagaaagtctaataatgattgatggatcacaaacagctctccatcaataacatcaatcagagttcccagcctctctttgattaggtcagcatcgagaaaaattctgtcctcgaggtaatccgcccaattgccgctgttggtgagcatgactgctactgctgtttccagctctctcaaagaaagtggccttttggcaaatgtcacccaggctagaatggcaatagcatgcctccctcttgaggcggctcggaacagatcggtatacagttcgtcaagctcccggggcgtcttcttgatgacttgctggactgattttttactggggaaatctattttgcgaatctcctttagtatgatgtgtatccaaaggaatgtgcctcctgcacggctcaaaattccctcacgaatgtcggtgtgaaacctgttgaaactactcggcagcaattccagttgtttcgtaataaatacttggacgtcatggttgggttgtctaagattccgtcttgttccggacgggcggtttcctactgggccatcgggtctactagtaaggaatagccagattgggcgccgccctgccatctctcccagcttagtgacgagatcttccatccctacagtctcatacacatccaggccgtcgataatgcagaagatccgactatgtagaccgctctgtaccaaatcatcaaagggtcgccaaagttcatcaaaggttgctgagtgaaaggctttagagtctcccttggcttgaaatcgattcgggagtttctgaaagtatctcttatccgtgcatagctgtactatcaaagcccgcagaactgatgatgcagttcgtgcgttgccgtccttgatgttgcagaagaagaagatgactttgttgcgctggtttttgacaaactgttggatgtggtttaccacaaagtttgatagtactgactttcctagccctggcggcccgagtattaggaggcaagatggtgttgagctgtctctccatgtactaaagtcttcgtattgcaagctatcctcgccttgtggcctctgagaatccttgctcaccagccattgaagcgatccttcaaccggctttgctagcttttctttattttcgtaaaaggctcggtagtcggggacattcaagtcatcccagtgtcgtttctgttcttcagagagttctagaacaacaacacgttaaatatttctggtgaacgatacagcagcattacttctacataccgattactgattgaaaccgtctagggacaagatcacaaccttcctgaacgagatctcccagcttatcctggacaatcctgtaactcggatccgcgagacgcgtaaacttgaccaaatcagaatgatcaaaaggcagtgggtgttggctgtgtgtatcgtcctcaaaaccgatccgacacgctgactcttttgtaacaatgaagcatggttcacccgctcttcttagctttccagtatcatcaacctaaccaattagggcgtgtgtcagtaaaacttttcctttggtagtagctgagtggaatatgaataaacgcaccgcaacagtaggtgttttcttctcctcataaaatgatatgattttcattggcggcgtttgctttcgatggcagctaatgaacttttcctggaggccttgaagataagaagtcggctttgattccgtgtcaaccgagagatccagtatgagttgcttgtttagatgttcacgggtgatttctttgaggctttcgtgctttagccccaggttcgggacaccaaagaacaccagcccgtatgaagacatgcaaaagtccctgttttgtgcatctctctcgccatccgaggcaaggcacagtgcctataaaacgttagttggtttaaagtaataggcgtcaaagatataaacatacctcttttatcagaagcccaccgaggctgtggccgaggaagatgattggcctctgagttgtcttggctatgtcaggattctcgcggtagctgccactgaaggataagagactccacatactcttgtatccttccgaaaggtcttataagtgttcaagaaggttttccctaaaccagagattgatattttatgatccttgttcatgatcgatgaatcgtatccatagaggagaatccgactattaggaatatcgtgtggaagactatcgcgtagccagacgtggctggtccctttacttttgaacccgccaatcgcatggctgcctaggccgtgaactgcaataatgctacgcaatttagcttgagtctcacgtgtgtgatatggattttcatactctatttcggcatcttttgcttcgaacaagggggttatgccgaagaatcccgtgtcaatggggtattccagacttcttgggataccggttgacataaacgtcgcagtctgatagttgccgaatgacctcgcgaaggttaaatgaaggttggacggctcttgctcatcaacagttggagccagctgacgctgaagctcctcttctgtcacggattcagggatctcttggattctatagcatgttgcttttgaaggaattccagcctggataagtcggtcgttcgtagacgatatgttgtttcggcctttcctccggccagcatcttcgcccaaggcaaaattcgttttgccaactctccctcggaaattatataataagatacaaatagagcaaataaaatgctcaatatgataatcccagacatggtgttgaggtcaaaagagatgccgaattagatgaacaaaagggtagttttgaagaggaagatgttgtgtaggtaaagctgacatggcgacggcccaatgccatggccaatactacgcatagttgcataagtacttgtgaaatctgtcttgatggctctgttcaactattctggtttggctgagctgtgtcacactgcgggtgtgactgtcgatccgccttgagttacattttcatggcccggcattgggctcctactgaacccacaattgaagaggggtagtaaacttatgcaacacttgtggcacagtatggcaccttgggcgcttatgaacatccacgctctgggaagaaaaacagggactgcaaagtcgcttcgatagaactattgtggtagacagtctcatcatattacttcctattatatagtagtaagaatattccctaacaattgctaagtaatttcttcttcttattgttactaattattgtctgtttatatagtggcctatattagaaactcaggattaaaacaccctggcagtccctgttattctgacatccacttggggctaaaaaatgcaacgcttattatgcaggctaaatgagctggagacagtctggcgcttaagacgatctgcattctgcttcacatgtaagatacctacgtacagaattccgtacttaggcaaccacttcactatcatcagagcagggaaagcgagaagaaaggctttagaaatatatataattttatatagtctggcaatacgaaactcgacatccaaagcaatatccgtacagtggcaagccaataaatagcacaccaggcgcccaaagaacccatcaaacagccgcatcggccaatcccgtcgtctcgtgaccatcgtagtaatgacaagagcctcattttatgtgcagtaaagtccatcatcttcctcgttagagatcctcaacccgagctatggggctgttcaaccccttataactcgagggtgacctcctggccctttacacgaccgatgacctgctccggggcgtacttggggatgacctcgtcgtcgtgcagcatctcgaattcctcagtggcgtcacggcccatgaagttcatgattgcttgggggccgccggggtgctcttccagccagttagacaggtccatgacaacgcccttgacgacaacccaaaggtcacccttcgtgttgtgcttggcaacctcctccatggtgaattccttctccgggaccgagaaattcttgggatcgggcttggcgggggcacttacttcgggggcagcggcaggagcagcggcctgtgcctggacggcgccggagccggagccaccgtttgcccactcaacagtaagcttgccaggagaagaagggtcgaggtggagagagatctggccaagacgctgggcggcaccagtctgtccctggagggccttctggaagaggtagttgctggcggtgtcaccagcaacacggccgtaaacaacacagcccagaagagatgagccaccgagacggttagcaccgtgaacaccaccagccagttcaccgcaggcgtagagaccctcgaagggctcctggtcctggttgaggacctgggccttgtcgttgatctcgataccacccatggtgaagtgcagcacgggctccatcagggagacgtggaagtcatcattgatgtcaaatggcatgttgtggaagaacttcttgccccagggatccttctgcttaccctcggcgatggcgttgtaggtctggaaggacttctggaggtgctcaggggtgcatccaatctccttggcgagctccttgccagtcatcttcttcatcagaccacggccagagtagtggcgagtgtggaagtcaaggacgttggaggccttggagttgaggacgagacggatagggaacttgcccttgtccttctccttccacatcatgcccgagacgtagtcacggtgtccaaggtcgtcgcagaagcgctcaccatcggcattgaggagaataccaccctcaccacggagagcctcagcagcaaggaacttccacttggagccagggtccttggggtcaaccagaccggtagggtgcacctggaccttgtccatatcaatgccgttaccgccaatagccatgaccatcttctggccgtcaccagtggcgtgggtgccgttggtggtggccagatcataggtatcaggacggtgcttcttcaggagcgaggtctcgctgaagtcggcggcgtagccaccagtagctaggatgacggggccctcagcaacgagagactctccgttgaactcatatgtgacaccagtgaccttgtttccctccttgttcaggctggtaacgcgggccttcttgatgatggtaacgcggtggggttcgttctcggagagctcttcgagacgctgcatcagggcataggtgatggccatgccggggaacttggcgtcatggccacggtgtgttcggggctgagagtgtccactgatgcacggttaatcgcctgatcgactcatgactggtgtaaatgaattgtggggagtcgaagcatgtacataccctaaccgcgaaacaagagtcaggtcgaggttgaagacgtcctgcagccactcgacagcggcagcagacttgtaggtgaggaccttgatgaggtccggacgggccttgtcacgggctgacttgagtgtatcatcgtagaactgcttgacgctgtcggcgacgccctgctcgacctgcgtccttgtcaaggcaccgttgatgccagaagtggcctttgtggagttgccgccgaagaaacctgtaccagaaaccatcaccatcagcaaaaggctttcttaacatgtgaagccgactagtggcggctaccaccatcatggactctttcacatgacgtagcgcagccactggcgaaggaagacccggatcgaactcaccctgcttgtccagaacagtaacgttgccaccggcgaggtagatagtgtgcgctgcactcaggccggaaactatatgcaattaagctgtcagcatgctgtcgtgatgcttcccctgtgaaggcgcaagcagcgacgctttgcgacggaacggaaaggcgacggaacggaagggcgaaacttacgaccaccacccacgacaatcacgctgggagccatggctgtgtcgaatatcaaatatcaataatcaaatgaaaaatcgtggaagcagaaaatcgagatagagcgacgtgtttgggggaagaggaagggagacggatgagttggggaggaagggaagaacgagaggtcagtcgatggctaatgaatgaattaaaagcccggtccatggaagcgtggagcttacgccgaggaccaacttgaggcggacggattgcgggcggtacgtatccgtgcttgctcctgcactagccgaggcaccttcattatccaccccatggcaccatgctacagacacacggcacgttctgcgtgacccccagcccgccgcgcccattccccaggattccaatgtcacgacgagcccggccactgaggcaattgccgagtcaggcagcctgcgagatcgatgttcctcggccgtcctcaggtacctccccttcgctgttcgcagagcctgcgttcggcctacccgccaccccaggtccactggccgctagcgccatgcctccaactgctcctaggagggagtactggtacttgcatggagacctacctgccaagtgggtgaaataaaacatggcacaccaaagctctttccgcgcgagacagggacctcgtttttcaactaaacacaataagaagagaataagaagagaataataaactattctataatatttagcttgatattgtattcagtactaggttatttattgtgatattgtgttgaatttcagtgctgaactatctcgatgtgctatgttttattttacccacttgctgcctgcggttctctatccccgtccccacagttggagaacaacagcaaagacctttgctgttgcatttggaatgaaaattccagggggctaaatctccatttgtcctgccttccccatgttccccgatatcgcgcgtatctatcccgttgagtgttctttgggccaggtgctgctattggtagcaaaccacagtgacttgctcgctgcttgatagcccgaaatggcatgatgccgggctgtataagaccgaagccgtacaacaatcaaatgctatgcatgaccccaaaaaccaaccgaaaattgatttctgaatttcaactacggatcctccccatcagctgaatccatttctgcaataataagccggggaagagcaagcatgtgtgccatttggccattctgatgacatgtgacggctcccttggagaacgaggtaccgctacatccgcgctaggtccagggcccctcccccacgagtcccccagatcatctgactcgctccgtttcgtgagcagcattcccggcttcctgattggccacatgtcgaagcatgtgaaaggccattcttacatcccttaatgaaatcagatgtcctcgaaacgcatgacgacagaaccacccatcagcgagaacagagtatcgtgaatctcatccccgaagacccctgcttctactccaattgattttgcaacatatggtctgataattagtccattactgtagcaaaaagaaacggccgtctctgtcggaaagaaccccgatgctgactgcggcgaaaataccgacggcataattgaaaatacctcccctgagcttcgcacaggtgccagcacatccaagttgtacgtgcagtagcaaccaatctaggaccctacagggcgctcagggggctataacgtaattggcgacagtttgggaaggcaccagggtataaattatagattccctcatgggcgatttaacttttcctcatatataatgcaactttccctcatggatggtttaaccctccctcatggatggtttaactttccttcccttatggatggtttaactttcccttatggatggtttgactttccctcatggattgtttgactttctgttatggctacaaaactatttactcccagtctgttctgaattttttcttcctcgtccatacatccatcccagcagcaacagcaacattaccaaccacagttttttaatactgcaccctcgcttcatatcgttactatcatagttcccgatacacattcttcacatcatacagagtccgtgatactggatgcgcctaagatatctaataccatcctcgcggtcgtaaagcatttatcagagaagatcaacaaattcgacgagaagatcggcaaattcgacgaaaatttcaagaaagtccacgccgatgttgatggattgaaggcttcaaaccaccaaatccaggctgatatccgcgggataaaaactgaaattcatcaaatcaagactcaaacaagtgaaaccaagattagagtcgaggatatttatgctcgacaggatcaacaagccctatcagaaacagtccggtttgtctaccatctggagttgaatactatttatttatctatattttactaacttttttactaccaactaggcgacaaaacaataagaagaaggaaaccaatcgactccaaatgcttttgaatccagaagcggttttacttccactcatcgatgtgaagacaggagaagcgatcgagtccttccctcaggatctcgaggcattttatcagctggatagtaggttcagttgtattttagcagttgaactaggctaatctattaattccagtctcagaaatgctccatatccttcgtgctctcgatacaaacactgagaaagtcggtattgttacagtccgagagactctgaggaatgccattatgtgaagctatgggggacggggtttgattctgttccatataccgctagtatatgctcctcgccaccagggatccaattgttctcaagtggctcgaggattctcgggggaatatacattcacggattcaattgttgtcgattggctcgagaattcacagcagaatgttttcagggatctaattgttgttgattggctgtgccggttgggtaacttacactggacaggggtcaagggtaagttggggttgaaccaatcagatgttgttctgagtggcgcgatcaggtaggctgtgcaatgcgagtcactgtcaatgtgcgagtattgtggggctagtaacaatagatgcgtagacaatagtattgataactgtctaagagggtgtttctatctatgaaatgaatgtgtgtatatagtaaggtgatatgttggatatggaacatatccgtagtgatcgggtgctggtatggttgatatgtaggatatcgaacatatcagacttttgcacgtgactaggcgcgatgactaaggggttgtcaacggttggcaggggtttgttcgtaacattggctcgagaattcacagatgaatgttttcagagatctaattgttgtcgattggctcgaaggattatccggtgagttattacgcttgaatgattaggtagaaataaaaatatggagttggacacgctaatatcaaatactattgcccccacaaaatggacggcataattggttctttggagtcacgggatattgcacgtgagcttatcgcacgcagtgcgcggggctatcagtagtcgacggcttgaatgacgtcgacctgcctgagtatttacgactgcacgttgccaactttcctgttgccaaacgctctgcattaacccaaacagccatgaggccactactcctcctctcgagcctcctctccctcacaaccccatcgtcggccgcctcaccaccacagcacccgctcctccccgtcataatgcccccaaccgcctcctccgaccagccgcagaagcagcccgccgtgcccctagtggacatcctcgggacccagcgctccatcacgaccttcttctccctcgtccgcctccacgagcccaccgagtccctcctcggcgacctccacaccaacaccaccgtcctcgcgcccctcaactccgccatcgaggccctgccccgcaaaccctgggaggaccccgccgactaccacgccgccggcgcggacgcctacgagggcgaggacggccgcgagagggcgcagcgcaacctccggcgcttcgtcgaggcgcacctcgtcaccgccagcccgtggcagcgcggggaggagaacaaggcgggcacgctcaagggcgagagcggcaagacgagggagctgtggtgggagctcagggacgacggcaagagggtcatcatgccggacggggtcgaggtcgaccgagtggccagccaggtggccaacggggaagtcgtgagtctaaaatgatcccccctcccctccccggttctatttttgggatatgtgccttgcagcgtctggagaagtttgctaaccagatcttagtggatcctcaagggtgttttgaactacagttgatttagcattatatgatagagactcgctttatgattagagatcagatttatttaatatatatattgccaagtaaaccgtccagctcccaggtctcatatcagggcccctgtccatcaccagacttgaggtatgatcttctttcatgcacgtaaaccatcttcaactaaaatagccacgccaaaagaggcagtctatcacgttcagaccatcacgaataaatattgttgtaaagcaaaaaatgagttcaattatgccatcctagctgttcgccaatagtgcaacatcaaaagtctactcaaatgaaaacacggaactcaaattaccaccacactgtgtttaaactcctcagaacgcctcccatgttatcactaaatttcagtgatcatcaaccaagacattaccaaacgataaaaatgttttcgatgtttgcctgcaaatgcatcccagtccatacaacgtccaaccatgaatgaataatgtagataataatttgcaagaagagtccaaagccgagtgcaagccacattgcgagcgttgcggaaattggatgaggtatggttcattctgacaggaacagtcccgttcaagagaaggaagcaatgtgatccaaagatgactccgtaggagccaccaaactcaggcagagaagcaaagaagaaggaatggacatccgagtcccacatctagaagaaaaacgccgatagagcaagcgagtaaaaaaagtcgtaggacttggttatgtatgccagagaagagcgaataacagaataaagtggtatctcaaaaaatgcagtgaaatgaagaggaaaacggccatgtcataagatcagaacaagatggcatccgtaaatatcttagttgaccttgactctcttggcatcagtagtcaggtcgtgactctcattgtgatcgttctcttcgtccccgatactcttgcgtttccctgctccagctgtagctgtagttgcgctagctgtaggggcgctggttgacgcagtgctcgagttgaagttagtctcctctctcaagaagctagggcccgatcctgcaactggggttgcaaagttcagcgggctaggcaaggtgttatcaccgttgcgaaagttccagtcgttatagaaactgctcggactcggcagaaactcggtaccaaggaatcgggaggggagtgcagaggctggtgtctcagcattcatgttctgctgggggaggggacgggcgaacgggtttggtggtcccgtggctccagcagacaaaagtgccgaggcagcagagggcgagggcggtggaagaaccactccagacgaatgtgagctttgttgttgcgatgtttgagatgtgctctcagtcgcacccttaggcgagttggactcagaaacagcgctgttaggctccgagccaccaccagggatctgaactgtgaggcgagggccccgtgggcgtgctccgctcgctgaacctggacctgtcttgaaactattggatcgagagggcggggtaaaaactgtctcggtagcagaagagacagaggttgtccgtgttctggctcggttctgaggtggtgaggtacgggcagcagacgtcacatcgaccgagtgtgggcggttagcattagccgcagctgcggcggccatagattccgacttagcgggttcagatgcaaaggatgccaagtgctgcgagagaggcgaccgattttcctcgataggagtaaagatactgtgcgacttccttgggagcttcttgatggccatgtcggtgttcaacaaaggcatttgagggcgatcaaggggctcattctttacctcgggcggtggcggtggaggcagaagttctcgtcgttccggctcagggggggtcgtggaaatttgaggcacgttctggggcggggcgaggtttgcttgaggaggcgatggttcagcgcgagcgggaggcatggacatcggctgaggctgagggggggtctgcgacatgaaaggaggaggcggcacagatgatcgtctttcttccatatataccggaggttgaggtggctgcggctgctgctgaggtggttgcggtacctgatgcggtggcccctgatgctgcggtggatgttgaggtccctggtgtggtggtggctgatgctgaggttggtgctgctgcggcggcggtgggggtgcgtacggatactgaggctgctgctgttgttgaggcatcataccaggttgaccgtgagggttattgtaaaggggaggtgttggcatatagcccatgccgggatggccgccctgaggaggccccatgttgggccccatgcgacgaacatcgttccttgaaccaggtcgcgatccaaccgaaggctgcggtgtgtgtccacgatggtgaggatgtccagggaatgtaccattctggggcataggaggagatgctgaaggtgtgtgatggcgaatttgagggaagtgcggctggttgtggtactgcgggggcatcaagtgcgcttcgaggccttcgggttgagggggggtgccatcgccttcctcgtcatcgtcatcatcgttgccgccattgaaatctgagggacccttgtgttcgtttggaccaccgtgctggtcgcgcattgttagcctgagatgcgatcctgtgcgacgcgttgggaactcacgtattggtatctagtaatcagatcacgcatgtcggctgacgagtactcgtacagcttcttgttgttgccgaagacgaaaaccgcaacgtcgacggaacagagcacggacagctcgtgtgccttcttgaagagaccgcctttgcgcttcaggaatgtgctgcggaacaagttgtgtcagtagagcagacagataattggggatggggagagggtggacgcgacatacactgagcgattgcggtcatccttgatggctttgatctcgatctttcttcgacccatctttgcgacgtatgtacgtgtgtcgtcgcgagtgacggtcgattgtctagcgaaataaaaagggcgaccggcgaccaaaggtctgggcctgggtcgtgcgaatgggcgacgaggtcgaccgcgatgagaggatgagtcgcgccagttcgaatgtgttggtcgcgctttccaaaaagctcggatagagacttggttttacacaagcggcagcgaatgtggcgagcaggggtggtttagagctctctgcgacaaatgatgatgaggcttaggggagagacagaaatagaaatagagaagaaaaggcaaaaagaaaagacaggaatgggaaagagttgtgcgtggttgtggacggggccggtagggggaagaggcgggatcccggatgtttatgaccaggtgggctttctgatgcgcgctggagacaagggacagtatttgggctctgcgcaggtgaacacccagcgattcttctgtgcgagggccttgtagcgaggcttaagtgatggtgttctgtggtttgagtggtggtgcaggacaatggggctgaatctggcgttgaatgttctaataatagatgatccggattgtgctcatgctcgccagttgagaaactagaagggggagagaaaaaaggaagagtgcaaaagggcgggacggtgtgggaaccggaaaaacccttggctgttggacgctgagccagcaggtggacacagtcctcaggtgctaatggacaaggggtcaaccttgaaccaaaatacctccctggcccacctaatgcagaccggcagcgaggtaccagcttgttcagggcaggtacgggatctgcacagtgcgaaatgaggagggcttagcgcgacccggattacgttacagacgagaggagaggggagaggggaactgccctaaggtaggaaggtactaggcgaggtacctgtctcacggtctcaccaccaggtgtgcagtgcaggtactggtaatcaaaggcttgaaccctgacacgggttgttcctcgccccgggctctggtcgagatagcttctgtttgttctcttgactccaagctttggccatggcagttataccgtcgtcgagtcgagtgctgtcggttcacccttagctcccaagcttaggccagtcctatgctccgacgacaactaggcccggtaccgtgggaaactacctaacgggcatcttaacccaaagttcttctaggatatgcagctaagacaatcaactgtggcctctacaaccgacaccagaagagcctgtctatcccctggacagtcgctggacgatggaccaatctctgacccggcagtcaattcacctcctcacccatccaacggtaaagcgtgaatgtgcgtcacctgccatccatccatcccatcccccacgcacacacacgcctagcttattcgcggtggcagtgctgcagcagacctgccagcggcgctcgatcccatacaccctttttaatctgatctcgctgcgatttctctgcgacgctgcatgtgcatagcatgcaggaggagagcgagtgccctaaattgtagggcggctaaccagggttacatagtatcatcaagcctcagaaacattgggaccatagggcctttttggaattgattgtcctccgcaaacggctcgaaggaatcggttgctcggagtcttttccatattggagggctagggttgttcatcgaaatgatgccagggtggtggacagggtttctgctggagtgtgccagttcgtcaggtcatcaatctacctcacataatattaggtacgcatggagaattgtgtccacccaggctttggatgcgaccttgagattcggaagtattgatatacccagacaaaatatcgcgaggcatcgagtacgacatcatcacgaaccagatctcgatagctttttgctttttgtgcagttgactctagcacctgagctcaaaacgtcgcgctcctctaccttacatcaattacctagccccgcctataatatccaggtctggataatacttgcacacgagcacacccaatcgagcacacgctacaatgtactattccgcgctggtcgttgaacaaatgcgcgggaagcgaacctacaaacaaaccactgcagccacatcacaatgtcatgggatgctgtggccttggcaggtaccttgcgcacaagcagtcatcatcgtacagcccatctggaacctccaacctggttgtgcttcagcttacctacatggacgcagtacatgaacgcgtacagtgcgtgcgcaccgtcagacgttctctcagctcacagccccaaaagccctgcactccagctgatccgccagccaaccagagaccgagccttcccgacctgaggggaaccagcttatcgaaaagtccaaattttccaatctgagacatgagcaaaacctcacgcaaccacgtggagaaagcgctcttccccatcccgagccttgccttgaccgaccaccggcattctgccacttcctcccgccgccgtggcaatgtgtagccaaaaaaaagaccacggcggcggatagatctaccttatccctttgcggcgataccttcagcgtaccgtctgccaggtaatcaatcaatctatcgatcgattgatggtaacaccgggccagcttatccattgcgccggccgttgcgctgccttcgttacccgtcgcgcactactcatgtacctatgccttgatggccgcgagaccatccaatcatcgcgcttacgcgcttgcaaagtaattgagcggcacacgtctctcccggcattgcgcatccttcacctgaacaacttgtctcctcgaattcttctcttgccgcaacacgatctaattggctcgcgaccttctccacctggaatcccattgccttatgtccgcatccggcttagccatattactaagaatacaatttgcctggtagtggctccaccgcccagacccatcgagataaccgacgtctgtcaccactcaactcaccatttaaatgcccaggttgagttccaagattcccgccactgctagcaaaagagaaacacaagaggcgatagaaggggggtaacaggacaacccggagctgtggcgggatcctgcgctgcgcagttccgccggacaagcattcatcccgctcatgattccgcctccacggccacttctctccctcggaccaacagacctgcctgggacgcttcgcattatcacaagacgtttcatcggtgcacaaggaccacaaattttcgcaaaccaatgcccacggccgcagcaccaacccgccgccggattggatcagattcgccctggtggtgaggggcagttaagcgcccgggcgataccccgatcgttgacgaccacgcgcatacctcttcctcttctctgccactctcgctcacacacaccgaccagccagccaacagcgcgcagtctcatccggacccaacaatcaccatccgcactggcatgacggccttaatgcaaagcctctctagctgcaggccgtcccccacccgccattggccagaccagctttctttctgtcagggtcgcattggaaatttatccacttgcaccacctccaagcttgtgtttgcgctatttttaggcacccctgcacgccttagttagtgccaagctccggagggggacaaagagtgggctaattaccttggtgagcttctgatgaaacaagggtgggaataggcaacactgtcgcctggctacctaattgtccgccaacccggtcacacgaaagcacttcaccgcattgcacagcgcagcacacatacggcacctggcctctacgtagcacgtagcacacgtacatacgtcccggcccttacctctcgtagttgtggtctgaggcgaagcaaaatacttgcatggctcatccagtcgcaggtcatgctcgtatttatgttgaattgttcgtattccactacgtgactaaagcagcctttatgcctgttttctgactcgtcaggctcaaatcgttctcgtctcattttcagctcagctgtccattgtccccgcggctcattagtgtggttggtaacttgtagccaatctgtcttttcccttaaatcccaaaaacgccagtgcttgatcgatcctcgcaataatacagcctccgactacttgaacaggtagggaaagaataaacaccggagtttgtgttggtgtcttagatatcatcaaccatcccaaatccattaaaacaaatctcaccaagcatcatgtatcaccacaagtgacccccaaaaaggattgtgcaatcatggagaaccagcggtgcctgcaggggcgttgtacgaaccgaaacctccgtggtccgcagcaccgttgtccgtgttcatggtaccgttaagcagagggcataaccttttgagcaagtcagtaaatgtgggagcaccatgtgtgagcagtagttgtgtgtgagtgtggtgtgagatggtcgatgatggtgagaaattagtccaatggttcgagagcgtcttcgtcttcatcgtgggctgcccactctgacttgtattgtagagcttctttttgcagccgttctttcagctttagcaattcttgtcgctcttctctctctctgttcgctttttcaagacgctctttcgcacgttgcttcttgatctgccacttggatggcggagcatccggcgcacgcttcttgcaacctgctttggcttcgcgcttctgtcttggagcctgcctctgcttgtctttcttcttttgcttgtccaattcctggagcgtgtggaccatggctggtaatctcttcttcttggacttctttctcgacagacgcaactcatcatcgtcggggagagtgacactccaccaatcaaaagacgggcgtgggggtggggagaagggttggggttccatactttttgtttgtcttgatatgtcccacctggccgcaattggcacacttccgggttgtgcccgtaacgatcttatcgccggaaacgaccgcgccgccaggggatccagcatcaccgggggcattcgcccgctggtggagttctttctgctgttctcgggcttggcgtcttgccttgttcttttccaatcttgcaagttcctgcttaattctaagagaaggtagacgtgttaacaactcggccaaacaaacacatggggatagtctcaagcttacctaatccctgcaagacggtcatggtcggcattgccagtgggccgcgagctgtagatgctgtaaagacatttatgtaagcaggcgctcggaatgcaaggccaacaatatctgtagaggagcctggtgttcccaggccatatgtggacttggtcctaatacattgttctgcgagaaaagccgacctatggagtgatctgacagaagcgggtaacttccgccagatacgaggtggttttcgcgacaatgttgcgaagcgaagggattgtttgacgtactctcttagttccagatcagcctctgttctccgcttcatgtattgcgtgatgacaacagggtcgtagacaacttcgacgcgttgctgcgtagatccgtcagctaaacgaacatcacgagtgattctgatcgctcgctttgcgtggcggcttgaggacgtgaaaccgcttatctgactcgtgccgtcatcaatgtgagcaggcgtcggcgctgagtgaacgttaaagcggtcgtcttcatcttccgtcaccgcaatatcattgtcatcgtgttcttgagggtctgacaatgtagatttttgcttttcccaaatttcccggatgccctcctcgtacatggcctgctgcttcttgacattgtacgcatggccgccgttggcgcgtttttctcgctccatcgcgtccgccgatgtggcgagggggccttgaacagcctcgatatagcctcccttcatagatgtacggataaagctgaacccaagaccatggcctgtaggatcgccttcgccgtggagttgaagcatagccttctgggcacatgcatcaatgaatgccttggtagttttccaaggagccatcttatccgcaagtgtctcctcttgctgggcagccttttttccacctcctgcagccttgacgatcttactgccctcgtcatcatcgtcgccatcatcagcatcggcgtctgccatctgaacatcatcgtcgaagttggcatttctgggatcgtacccagcatcctcgagctccttgatacctagctgcatagcatcgagcagcgacacctcctcgggcttaatcatagcacggacagagctctcgtcgggaagaatctcccccggcttcagccgccacatacccttctcgccactcctgtcatactgaaggaattctttcagtttctggcgattttgcgtatcagtggattctgcaatatgcttggtgatatcttgcaattgacaattgtcagttttgctgtgacgaatcatacggaacgccagcattttcatgcgattcttggatgcattggtaacctttctgctgtggggtcctggtacttcgaccgaagggaaagtctggccgacgacatgcaggtgatcgatcttgtggataaaccatttggatccatttgttccagtggtactgcgcactatgagaaaatccgtatttcgaggagtgtgtttgaatactggagctcgatacatctcgttatggagagtaggaaccgtctcaccagcgtcaacggttccaaacaacgagaatggcgatcggtcttcgggtagcaacatgcgatattccccaagctctcgtttcgggagctgttcgtcgtctttggcgtccttccgacggtaatagttgataagcttgctacccatcccgaaattgttgagtaccctaggtctaggttcacaatattcaaacaaaacagctgtagaattgtcgctgatactaagcgacttggagtccttgaagacctctgatatcttcttgcgcatttctttcctcctgaaatgggctggcttttcaaacctgatggactggccaacaaacttcttgtatcggaaacgtgggcgatggtactcgtccgttgtgccaggaagtttgactttgtagtatggccaagtgagcttgatggcaggcatactgtgttccacggaaatgttgccgagtgtcgcacgcaccttgctctgatggttttctttgagcagttcgtatgcgtcatcgttggacatattaaatcgcgaaaacaaattgcgactgatcttcccactcggaacatgcttcccttcaggtccgtcttgacgggggcgcttagcaactcgttgagattcttgaggatcaatgagaaggtggggatcggttgcgtcaagctgcactcgtttggcacctcgtctagtagtttcttcgaaattatcgaaggatggggcagtatatcgtgggatgtctgggaggccaggtttgatcgttttgcgcttcttggggggcgctggagtgtccaccacgtcgtccatgaggaactctgcgttccattcatcatcgtcttcctcttcaaacagccgctttctggatgtcgcctccttccgctcctcggcttcgagaacagcaaagtctttctcaatcacccctatctgggtataccaatcttcgcaggccatctcgatatcgcgaagcgtgaatcccatgacagtttctgattcgtctacttgatcgatatcaaactgagcaatattctcctcttcttccaccgtgtcgtcgtagcaaaaaaccagccctttgtggtcgttgccctctgttcgagacgtcgctggaggcccaggtagtctgaaatgggtgacactatcttggtcgagctcaagcgtcaacttacttgtgacgagacgcttgggcttcttgaggggcttcttctccttccagatggccttctttgccggcaagagctcactccacgtaagaatacaccctttcttgtaagcaggccatgctgccttgagtaaatcctcgacagtctcagcaggggcgggaatatcaggatcttggttcgctgttaaacgtggctcgggatcgaaatttatgccagggaatatgggagatggttggctcggttgggtctcatcggcggcatcggcatcccgtacatgaggggcaggagatgggggtccaaggaccgggtcggttggcgaagatgggccttcaccgaaaagatcatccgcgtcgttgttactagtttcgccgtcgtcggtcaacccaggtagttccacggatgtgctcgcgctgggctcctcttcggggagatcgtcatcgctgatatcttcaaagtcctctgcatcgtcggctttgttcgtctggtcaaagggtgtgtcgtcgagcttcaagccgcccgatgctccatcttggctctgttctaggagtttcgcgatctctctatcgtctgccgcattttgggctttccagtcattctcgtcgaaggacgagaactggttatcgtccgccatgattgattaagcaggtgggcgcattccctcgaacttcctccaggcagcaaggaaggcgtcgctcgccctaaaccatccttttcgttgtttatctctgtgtcgcaacgttaaatggtagtgggattcgatggggcgttgctgtacgattccgaaggcgaagatgcgatgcacggcgagtttgcttggagtgtgaacttcacgcttgaggaggtaacggatcgaaggcgcgacgactcggctgagtcagcatttggagcttgtaccatctggggaatacggtccctacctacctaccctaaacatctctcccctagaaattcaaatgcaactctttaagtaaagaacacctaggcttcgcttcgagatctcaacatggcgtaggagtctatattggctttagtagattccactttgtttaacatggattttgggtttatgggctattgatgtgctcacatgcaagctatctaactgggggccacggcccagtgatggaccagtttagcccttttttccgaaggcgcttatgcttgtcaccagtctgtatatgttaattctgatagcctttctatgtgctaggttcaggcacaggccatagctgcggtaaagaaaactttttgtaaagcgagctacgtgtgtaccctgatcctagagtatcatatctgcttacagcaaagatggtcaactcaactcattcccagtctatttaaggaggcaacagagccgatcaccccggaacatcacataacacggactagataactcgcaatagtctgacggattgcattacacatctctaggctctagggttggatacgccaatatcaaataccattgcccatgaaatggagttcgtacttgcttaatgaaagttcttggtctccgtgaaaacagaccttgctagctttatccaagcaagggtgttcccacttcccggcgcagggcacatggttcgtgggtcaggtacaaggtaaacaagctccagagtcaataatcacaagcaatatgcgttagtgggaatagtgtctaaaataggacgtcgatatacgaacaaagcaaaacagcaagatgtgacgattggtaggcaggtaccttttaaatccagggatttctgtctcgcttcgtcttctgatttgtcctaacgtgaactgctggaagcaaccgtgctccagtatgttggctcgatgggcggctagggaaggaataacagcccggatttgagccctgcagacaaggtgtggagagtgacgtggactgcctctcctgatgattaagttggtagctaaggcataccagaacccactgcatgcgccacagaggtcccgattagatgctacaatcagtgtcacagctgaatgtcagacattacattacgagctcaatgctcgcggccatgtctcaccgtgcttaaatttttgccctcgtgcacgtaactgatgtgttttcctgtcgcagcctgcttctcaatcgcaagtccgtattcttccctgccaagtgcgcaattgtaagcctgccgagtccgcttgtttactgggcctttcagtccgtcattttactcacggaggcttcttggcgcccagcgtcgttaatcatcaagggatttctaggctgtgattgcacgtgaacagccgcaagtgctcccggatcacggtcgccaatccagcccaaagcagcattgctgtgtgcgcgctacgcctggctgtcgtcgcaggatccagacgaaagccctcagtccaggatgaaggccctcgggctggctgtgtctgtactgtgtgcggcatgtatcaccactggcgccgccatgcccgccacacccggcgcaagcattgctgagagagccgaagtccctggcgagcccgacttcccagaatacaagtatttccgtgagtctttatgaaccaacatacctaagacctatatgctaatcgtgattagatgagtcaaagttggtaccactgttcaatctgcataaggctgcgtaatgggcaacatatgctaacaccaagatcgaagaatgaattcccattatgatagtagatttatgaagtaccagtataaagaagattaccaaaaggtcctcatcagaggtttggtacaaacatacctatcaacatttcgaagcttaggtattcaggttcgtgcttatctcaaccagtatcctactcagccattctctaactacctgaaaacagacctggctcatgcatggaagtttattgggatggtggtttggccgtaaggcatgttgatccatctcaccccccccttcccgtacatgtgtcctaacagcttaacagatcatgccctgggaccttgatgcagatgtccagataacagaggccgacatgtattttcttgcggcttatcacaatatgtcaacctactacttcgagaatgaagagataccggaaggcaggctgttcttgctggagattaacccgcattataaacttcgagaaaccaaagacagacagaatgtcatcgacgcaagatggatagacacatcgtcaggtctctatattgacattaccgctgcgcgctacgccatcgggcacgagaagggcgagggtgtgttatttgacaagaatggccacgagtatcgggtatgttgacaccgctgtcttgaaatgctatggaactcctttaactaattatgttcaaaaggacacttatttgtatccattacgtgataccaccttcgagggcgtgtcagtgaagattccatatagctacaaggaaatgttggcggccgagtatggagaaaaggccttgacaaacaagttcttcaatgagtaagtgttaaccgcgctgaaacaagcataaaacaatctaacagtcgcgaacagccacacatacgacgagaatcaagagcaatgggtgttagcagcacaacctgattggtgatttgaccctcgttttttgttactattccaccggcgttaagggttgcacggcgacatggctcaatgggatcatgggaacaaatacggttacgcggagcatacctaagatgaattttacagcaagccccagaattgaattatcactgtcttttccgaccctaattttcgcatttatgttgtattgaaggtggttgtgctggctgcgtggtgaagtgtgactggtcccaggtgctggaatgccccgccatcagctcccgccagaaacgcgtctgccacacttactcaacgcgtctaattggatccatcaacatccattccttctttcaacgtcattgtctctgtatgcgcgcaacggtcattttcatagcaggactgatgcctgcgactcaagaagccatattttggcgcttcaatatatataggcctctgtgaagcggcgcaattcgtccacgatggccacgggtaggtacatctccaagcaatttatctggtccctctgcttatcataattaatagctcgggaagctcgcgcagagcgtctcaacgaccgtcttcgtggtgcgcagtaagtagagaatagaaaatgactacccgaaagtttttatatggtcgctcatggtcctaggcgcgtcaatcttggagacgactcgttcaacctcgacatacccggtcttgaccctgccgtgttcgcagcgccccagcccccgtcgtcccctcgccagccaggaagctcatctgcgaagaggcgcaggctcaatgatgaagcatcggattccgcctcgagcgaccgcagtggcggcgcacccaaaaacccgtacgatataccgaatacttcaaaggattccgaacaaccggcgaatgcgagcgcaacgaccggcgaacaggcaggaggaagggatagaggaggatcgcctagccctcgaaacgaggatctaaaccatgtccccgattccgaaggggagccggaagacgagccagacgagctggaagtcctaccggagccatcgagtacctcggcctctggaaggccgagtcgcgtgcgctcctcatttgttgaagagatagaagaaagtcccgttagcaaacctggaagcggccggaggagaactgtggccgtcagtagtgcgcttgcgtcgagcgcaagattgcgcgatgagatgggttccgacagcagcatgccctcgtcgcctctcacgcgcaaatcacggagaagcgacgctgcattgtcggataggagggcttccaggttgtcagagatggaagaattgcagtttgatgagattgatgagatcgcaagccagctgctgtcacaagcacaagagagatcgcctagcagggagctcggaggtgttgtagagcccggggagatggaggtagtaccagctcccgacgatggagaggaggaagaggaggaggaggaagcagaagagatcagtgcgacagaggcggcaaaggccctacgaggaagacgtcccaggcaaagccttcgttctgggtccattgagttaggatcgagagaccgcggagacggtgatgaagacgactatgaagaagaagaagaagcacccgagcctgtccccgaacctgctccccggaggcaacgtgggaagcccaacaagagtcccgccacacagaagcaacccgcccagaagccacggaaacgagcatctcaaaaacagaaacccgaaaaacctcgcccaacggcgccccctaagccgaggcgaacctccggggctcgacgtaagagcgacgagggtagcgttgaggacggtggcgagggagaaaacgccattgaagtcacggtgcaaagattcgtcaacttcagaaagcgtcgtagggatgacgacgaagaagcggacgacatcgatccgctacaacttgatatacccttcgcgaacagcagccgcgaaaatgcggtcgacgtctttgcccaagtttgcgaagaagtcattggcaatacactaagccagttcgaacagcatgctcagaatgcgccagatgcagcgaaaaagaaggagtttcgcatcaagattcgagctgttgaagcctatcgcgaggtgctaaaatctcgcctgctacaacatgtaagtttgttggagaatcgttggatgggctatttactgatgttttaggctattcacctcaatcactggcactcgttacgaaagcgggttcgacagactcagaaggagaaacttgctttacgagaggagattcttcgcatcaagggcgagagggagcaggtcgctcttcggatggatgctgtaagagcgaagtatgaagcagacaacaaggaagcaaccgtgagtcgtctgcacttaaacaatatttcatttattgtccactaatgggagaacatagtttctgctcaacacatcaagtacgatgtacgacattgacatggctgtctcaaaaggccaagacgcgccgcaactatctggaaaagcccagaaagaagccgagctctcgaatctcgagttcctcgtagcccaattaacagatcaagtcagctcttcaagtgagagcggtggaaatctccaccaggtccaggatttcaatgcattcttggaacgagcagcgcaggcgctcgaatccagatgaccgtcatgatacaagttatgttcgttatgattaaataaagggaacgccaggcctaaaactcaagggaagctcatctagctgatcttggcgttggtaaagtccatctcgggatgctgggactggaacttcttaagaatgtcaatcttcttctgctcgtccgaggtgggaagaccggcctccttctggcgctggtcaaacatcatcttctccaccatgccgcgtgtctcgccgtcgaggtcggagagcttggaggactcgggctggatcttcgagacgtcgatcttgggagccgtggtgacgacatgagcccaccactccatcttgttaaccttgtcgaggtggatctccacggtcttagttccgtccgagttcgtgatgagagtccaggtcgagtcctcggtgttcacatcgtggggagtgtcgccctggaaagcagtttgatgttagctcccttggcacgcagcaacattggggcggggctatgaacctgaatgattgggtcctgtcccttgataccagctgacagcttcttcttcttgatgtcgacgacgaggtccctcgacttgaggttcccggggacggtgaacgtgatgtcaagctcagagatttgctgggtccatttgtaaggcagagcagcctgctccttggcctccttggcgcgggcggcagcgtcttcggcgggattgggttctattagctgttagatatagttctaataagaatgccagcccgaagagacttcgagtcctacatacctttgtcagccatgatttttgtggtgaggctctgatgcaggtgggatggtttggagagggagcggcaggctacatggaggggcaatgcttacatagtacagggaggtgggacgcggagatcttagcgccctccgcctaaaatctagaatgtgcttcgcccattaataaatcaccaccctagactgccccagctcgtgggtccaagcttcccttatctgcaaaccagcctcgtctggtcttcatccgttaacactgaagctcaccctccccgcccattcagaccctcagcttcgaccacctgtagtcatgtcgcgaggcgccgtctcggtgcgccacggcgggtcgaccgcgccccagctcgacgaggacgaaacatgccccgtgtgcaagaccacccgctacttcaacagggacatggagttccgcatcaaccccgagtgctaccaccgcatgtgtaagacctgcgtggagcgcatcttcaaggacggtcccaaccagtgcccctacgccggctgcaacaagacgctgcgcctccgcggcttcaggtccgccttcttcggcgacctgaccgtcgagcgcgaggtcgacatccgccgccgcgtctccgccatcttcaacaaggtcgaggatgacttcgaggacctcgacgcctacaacgactacctctacatggtggagtgcctgaccgaggatctcgtcagcggcaccgacgacgcaaggaagaaggccgagggccagctgcaggagtgggaggcccagcacaaggccgacattgagcggaacaagcgcctcgcgcgggagacggaggacgcgcggcagaagcgcctgtcctcggagaaggaggcggcccgccagcggaggatgctggagctgcaggaggaggcggacgagaaggccagcgcggcgcggttccgcgaggagatgctcacgtccctgcagagcgccgaggccggcaaggcgagcgaggccatggacaagatcttgctcaggaagcgcgggcagcagcggcgagacgcggtgctcgatgcggcagcctccgcgactggcgggagcgggctgtccatccgtggtctcagagagaagaaggtgcaggtcgttgataataagccatatgatccgttcggtggattggatatgacgacaacgaggatcgatctgtccaacgagaagctcagcgagtacaagagcgacaacctggatcgtgccaggagacgggacgagcacaaggcagggggctactcagccgaagagtacctcagcagagctctcttcgaagccttttctgggctgggcgtgttcgttgaagaggataagatggcaaagggcgtgtccacagctggtgcagccctggctgccgccactgggcaaactggtggtaagatggacgtcgacgacctattctgaggcgtcgattctgatacggcctgcttggttcatccaattcacgttgatacatactcatgtgcatagcctatggcgttggggacaaataaaatctgggttggtcaagagactttactacagacgggttggcgaatcggagttactgtttatcactcattggctagaaaaagaccaatgcgttcacttgtttatagatggcgggtcggcgaaatttttgagtcctgagaacaaagaaaaaaaaaagctttcttgtgtatggctactgtgaaattgatatgtctaccgccccaagaagcttcactcccccaagctctacacctaaaatgccagagaacgcctcgcttgaatgctgcgactaataataacctaatgacttctaaaacaaagttgagccaaagatatgacaagatgaaataattccgagaaaaatggttgggcgggaagcacaaaatccattgtcaagctagacggatccagtccgatgaagaccgtgagctcggatagttatatattcgctcgactattgttgttgccagggggtctgttgtaagggacgagggaacacctgctgtgtagcgagctgatcgatgcccccgccgatcggctgctgattatgctgccatcctaagcctgtggcgtggttgacaaattggctttggcggaaggggtttgtcacacccgtaggctgaggcatgaggccgccggaaagagcaccaccggcagttacaggtctctgttgctcctgaggttgaggcgcaggtacggcgttgcgagcaaaagggttggtgcctgtcggtgcagctaccaaaggagcggcttgttgctggggttggaattgaggttgaggagaagaccttgcaaatggattcgtcgattggcgctgcagagccggagtaccagcaccagaaccaggcgatgaaagagtgggcgacatgttcgactggatgccggtctgttgtggtagcatggactggcggaacgggtttgtgctctgttgcccggttggaataggttgtagcgctgctggttgcgccattggctgtggctgtagccctggctggttttgagggaagtttgcgactgtattctgaggaatggtccctaaagagctgggttggaatccctgttgcggttggaaagcttgctgctgagggccgaaccccccaaagcccgcgcctgtcatgtttggctgaagctgtggtgccacttgctgttgttgataggggcttgcgttcaggttgggcattggcccaggctgctggaatccggtcatttgcggagggaaagggttcgtggtgggttgaggtggtgtctggataggcattgccgtctggttctgctcaattgaaccgaagaaatctatcaagtcgggatcagggcctttgtttgcttgaggtgctgctggctgcttggactcagccggcttcgggcttgggcttttcttgatcgggaacgggttgttcgaagctggagacggcagacgatttccaggcctgggtgacttgggcgatctgggagagctggtcgtgaccttcttgccttttgcctcctgctcagcgatgtactgcctgcgatggatttcgaaatcgggatccttgagataatcttccagttggcggccaaggtggacaggtgcatgcttgagctttggaacctgaacctgggtgtggtgctcgtgctgcctcgccacgctaagaaatgccacgacgaagtccgtctgtttcgtgaatgtccgataaatctccatcgctttttccgcatctgtcttggacatctcgaagaagtggcctggggggaaccgaagagttagcttagcttgagacatgtagctgtggcgggacatacccagaatgttgatcaagccctggttgagaacctggaacagggcgagtaaatctaggactagcaggcggaagacagtgatggtaatttcattttcgggttcgttgtccagaacctggtagaacgggacttgttagcttccccagggacagagctcggctggttcatggttctgaaacctacatcgcatttgaggagtgcagcaagttgccgctgtactatttccgtctgtcgtagcagacctttctctacaccgagctgttcgagcctagattctggagcgccaacccaatcggtctttgtctcacgatatgcgcgcgaacgttcagagagataattggcgtagtgacgaatattcctgccctgagtaacggctgccagctgtcagcaaaagcatgatatatgaagcgctgcgtcgggggggggacgtaccgtcggtgaagttggagatagctaaggcgttgcgattctgactgaggtaggccaaggtgacgttgggagatccctcacggatcatgaggtggacggtgatcagactcttgaagacaacggtccatgttgaatctcggaggcgatactgaagggcgcggatgacttcagctatgcccgcttcgcccgagtgggtggcgacgaggatatgctcgatatatttggtcttggggggcgcgttctgctcgacgagggttagctcaccaatacccgcataagccggagtagagggggatgatggaccttaattttggttgcgcccttgacggacttttcaaaggagctggacatggtgcaagcagacctcactgggacccgaagtcatgcgagctgtgtcggcggtgggataatcaagctggggcgggaaggggagcgagggcgaagaggaaagtgtccagcttgggccgatcatacgtagtcggtagacgcagatagattggggtggactggattcgtaaagccaagcctggagcccgtaattatgatgatggcgcacaggctatctgctgggtcgctggacaggggggacaatcggtggttgggcagggcgtctcaggccattgggccgctgagtggtcagcggcccggcagatacctggccgtgtgcgcctgaaacactccagtcggaggtaccttcagatttcgcctgtccaccacccaatggcttcctcgcgtggtggtggagcgcagctgtacacttggttggcatgattatattcgctgcacagagttccatgctgtggctagaggcctgtgactgagctggcacaaatatcccgcgaatcaatgcccacggcgcgttgtatctacgttgtagtcgcttgcaggtagcaatgtattgcccgtgcaggatggaccgtcggcggctgtgtggcgagtacttggacagatgcatccattgaaccctgattcaatgagtagcacatacttacccaattggagggtcgtgtgcccatgaacatgtatatcctaggacccctgaaacaggatatgatctggactgaagaccttagtttcacgtggggcaacaaaatatctccaaaagtcaagcccagtgcaccaagagtccaacatcggtggcaattgggttggatcaagtttaattactattataagttacgaataggctggctagggaagggaaggacggaaacgcctaatgcaattactgtgaaggactcgtgttggggttcgagggcggctgttgcacttgcaacgcgggtagtggcagtggggatgtagaaaccaagcaactcgagcggttcccatatatctcttccattctctggagttcagagcttttttccatcgcgtccgatgcagtaacaaggtcggtgtgtcgaacgcctatttcatactgccgttctcgcccttcctacaagaccacttaagccccagaggggagggttttgcaggttggggagaaggcaggcatcatatattcacgcggttctcatcatctgcgaatattgttagtttcaggctcgtggagaaaatcgcataggacgatgtctgtacgtacacttttttgaatggaaggattcatgaagagaaaagaagaaaccgaagaaagattcgcgcagctgggcagaatttaaccagcgacggaaatatttcggctcaacttttttaagtgggacactgcaaaagcgtgtgccaggtccgctcctacgttctgctcggaagctatagctgtatgcgacaccggcggcgggtttattaataaatacgggacctcgaattttggcaggcttctggattgtggtctgtttatacgtcttctaccgagcagatgcggcaatgacaacctcaatctgccgtcgcatggcatcatgttgcagggtatgccaatcccctagggcgacgcttagcattccaagattctcgtctcgaagcttcgggtcaagctccattcttcggacacaatcagctgttgcgtcgcagaagcgcagtcgattgttggatacctggtcttcttgtaagccaatttcttcgccgtacggctgaaacggtgctgatcgtcgatagaccgagaatctttcgacctcccgctggagaatggtgtaaacggacgatatgtgggattcattgggaagcgccggaacgtttccaagcagctctcgttcgccgacttgacgctcccctcgggacaagttattcagctctgctctaaggccgaactcgacaccgaggctcatgagaggttccgacaagtccccgcacattctcccgttctagtacaagtacatcccgaagcagtccctgcagtaggcggggcacaagatgcgacctcgacgaagatgacattcaatgcccagggcattcagacgctgaatagtatttcgaaggatataattgtcactccggagaccgtgtttccccagacaaagcgacatcttcagcttcgattccaccccgagctacaagcccgcctcaagtttcgttcctggctaaagggcattctcaaccaaggactcgttgagaaagggtttacggatgtcgagaccccaacactatttaagtctactccagagggtgctagagagtttcttgtaccaacaaggcagaaggggaaagcctacgccttgactcagagcccgcagcaatataaacaggtgctggtagcaagtggtattggtcgttatatgcaatgggctcggtgttatcgtgatgaagactctagggctgaccgccagccagagttttctcaggttggtcccaatccctgtgtcagtcgataagaattgctctaatgcgcaagcagctcgatatggaatgggctttcgcgcgggccgccaacgttcagaaagacatcacagatattgtattgaaggcgttgacagcattgaggcccgcccatagctaccaaacacttcgtggagagagagttcccgatctgtctgctatccctgatggtcccgtgggagcagatgaactcccagctcaccagttcaccaccctgactttcgcagactgtatagctatgtacggcatcgacaagcctgatttgagaataccgtctcgagtgagttgcatcgaatgatttctcgcctatcttgtattaacagccgaaagatttatcctattactattccggacaccgctcgggattttgtcggcatgatatcgcatctttctgagcccctcgtcgaggggttttcgttctctctgaatgacatttcgcctgatgcttctcgccggtttgtcaataaattcatgcaagatttaccctcatcatttacggacaaccccgatggacaacctcaaatccttgtatacgactcaatgaagcctctgggcggcttttcctccatcgggttcgaatacgagagtgttttagaccaagtatctggaggaaaagaacttcaggatggggatcttgtagtcttccaggcaagacagcaacaaaagggccagtatagtttctcctcgaccaagattggagaattccgagtggcgctgtggaaagcgcttgttgaagagggactcatgagtaaacctcgactcggcgaacccgggtcgctgcagttcctctgggtgaccgagttcccgatgttcaagcctatcgaggaagatgagccatggaaagtcaaggatgccggtgccgggatttccgcctgccaccatccctttacatctcctctgtcccagaaggacttggagctcctgttcactgatcctttggaagcccgcagtgcggcgtacgatcttgtcttgaacggcaccgaggttggtggtggaagtgagcgtattcacattgcagaagtgcaagaattcatcatgcgcgacatcctcaagatgtctgacaagagggtcaacgatttctcgcatctgctcgaagccctgcgagcgggctgcccgccccatgccggtttcgcgcttgggttcgatcgcttggtggccctcttgaccgatacacccacagtgagggatgtgatcgccttccccaagacaatgaagggagaggatccatttgtgcgtgctccaggtaagatcacaaatgatcagcttgagccgtacggactcgtgattgctgggagcaagaagtagccggcttccttcttgtcttctgagcttgataaatgtggcatactttgcccgcctaccccattccctcacccggtagatacactcatttgtagctgctcgtgtaattatacctccttgcagcctgtataatgaattctgtacaagtatcaatgtataaagtaaatagacatcagcaatgtaatactacgttacaaacggactcttcgagactggatctggtttattgttaattgtcgtatgactggcactcaagtcggtcatgttattttgtgctgtcggctcccgctcaaacctacctttccaggcttacgccgaccagtggcaccatcaaatacgagcttggcattctgttgtacaacagacggtttttttttggaggttgttgatggggtggtctaaggagaccgtcacaaaacccttaacagcattgtagataacctgatttggcttccgaaataactagcgctgcattaaataaaggtacatccaattacacacaaataatatgatacggcttgtacccatcttccttatccaaaagattcatccaaagtcgtaataattcaataacaaacagcacaataattcaacaacagcacaaaaaacacataataaaaggctcttattagctaacctttatcctctgtaaatagaagcctattttcagcagctatatctattgagatacacctctatgagcgagtatttatcgttatattcattcgtctttacgcattcgagcagtacttatgatctagtggttattgctaactaaactatgtacctgatacgattccaattcgggttatctacggtgccgttaagcaacttgatgacggtggccttagaccaccccgttgttgatgcgaaacaatgtttcgacttgaaaccgccatattaggcgtccttagtgtggcctagtgcggctgccagcactgaatcaatgccagcaattacaaccaggaggttgccttgaatgttgtagaacatccatgactctgatttttttattccaatcgaggagcatggaccccggtaaaatcagcaattcaagaattgcggtgacgtatcccggctgttataattatttatccatgaggcgggagaagatcgccttctctaggtaaataaattacttagtactggggaatcaacaacaccgccagtgctgggagaatagaaccctcatccatcaaccatgcggcctccctctgcgcaagcctctttgtctcttttgagcctgctgctgcctctggcatcggcaggtagctatgaatcaccgccggttttccccagccgtaggttttcaccaaatgacacggtccaataaacaaagcagctaaacaacagcaaactagcacccgggaagggagatggcgtctggacaaatgcgtatgcaagcgcacgcagcctcgtagggcagatgacactggaggagaaggtcaacattacgcgaggctttaaggcggacaatgtctgtgctggtacgactggcaccgtcccccgcctggactggccggggatgtgcctccacgatgctggcaacggcgtcagagcgactgattttgtcagctccttcccgtcggctatacatgtaggggccagctgggacaagaacctgacctaccagaggggctggtatatgggaaaagagttcaaggcaaaaggcggtgcgtcaaccaccatcccaaagtgcggatcctattgaagaagttatgctcacaaaagagccacagtcaacatcatcttagggcccaatgctggtcctcttggccgtagccctctgggtggtcgcaactgggagggattcagtgttgacccctacctgtccggaaagctcaatgctgagtccattgttgggcatcaagaagctggtatcatcgccaacatcaaggtacgatatcaagtgatcggagtctagtacccccgttgctaatttacatattgaagcattttatcggcaacgagcaagaaacctacaggagaccttactttggcgttgaggccgtctctgctaacatcgatgataagactctccacgagtactatctttggccatttgttgatggcattcacgccggcgtggcatccgtaatgtgctcttaccaacgtatcaacaacacctatggttgtgataacagcaagaccctgaatggaattttgaagaccgagttgggattccaagggtttgtgcttctggactggaacgccgtccatcatctcacgagcgcaaacgctggcctggatatggtgatgcctcttggagggagttttgggaataatctcactgatgctgttcacaacggcactgtaactgacgatcgggtaaccgatatggcaaccaggtgaatttgtctccaagcagccggtataaattcatatccttactaacgagatacagaatcgttgccgcctggtacctcgcaggccaagatggaggaaaattcccggagcctggaatcggcatgaagaacctaaccgaaccccatgagcagattgatgctcgcgatccacactcgaagccaatcactctggagggtgccattgcgggccatgtccttgtcaagaacgaaaacaaaacactccccttcaaaggtcccttgaagatgatctcggttttcggctatgatgccacgatcccgcagaccaagaataccgacaagctctttgagctgggctacacgtcttccgaggagatggcacaggaaaacttgggaacgccccagcactttgatcaagcagctaggggtggaactatcgtcaccggaggacgagccggtgccaacgcaccggcttatatgatcgatgtaggtgaactcctcgacctagacaggaacggttattctaacaacactatcagccactcaatgcgttacaacaacgagcagcagttgatgacacttgggtgaactgggacctcaagtcccacgacccgagcgtgaacgctgcctctgatgtctgcctggtcttcatcaacgcgatagcaaccgagggttgggatcgcgacggtctgcacgacgacttcagcgatggcctcgttcagaatgtcgcccgcaagtgtgccaacacagtcgtcgtgatccacgcagccggcatacgcctcgtagaccagtggatcgagcatcccaacgttactgctacagtcattgcccacctccccggacaggacagcggcacagctctcgtgaagctgctgtacggagaggctggattctcaggaaagctgccctacaccctcgccaaaaacgagacggactacgggagtgttctgcacccttgcgaaaagtcatcggacagcgatacaaacccccagtgcgacttctccgagggcacctacctcgactaccgcgcctttgacgcacagcacatcacgccacggttcgagttcggattcggactcagctacactacattcaactatacaagcatggagctcacgcgcgagggcctggccgcctccgccccatgcaacggagagaaccgctgggacctcgcagctaccgtcactgtctcgatcaccaatagcggagaccgagagggcgaggaggtagctcagctgtacattgggatccccaactcgccgccacgccagcttcgcggctttgaaaaggtgcgactacagccgggggaggacgcagtgctgacgttcgagctcgacatgagagactttgccgtttgggatgttgtgagccaggagtgggtcgtccaggagggcgaatatctcatttttgtcggagcaagcagccgggacctaagattgaaggacaagtttgttatttgacccattgatgcgtgggtaatggctaaaacgaagccatagtctagactctaggatctatgcatacgatccgacatagatgttaaatatacacacttagagcggtatgaacatgggttaattgtcaaatgatggagtcgaactgaagttaacttgatcgtctctgagtcgtatgaaagctggattcattaagggcacatattggtgcacaagcatgcactgacttgctcttcattgctattggaacaactacccagcgggatgaattacaaaccatgacgtaccatgactcccaagtgaatgaaacgaactcccactaagcggcttggtcgaagcaacaagaaaacattgggaagacaacctagttcagaaagaaggaagggaagaagccggagaaagcaagacatacctcatcaaagaagacccggaagttcggtatccccaaatacttcgcctatagcatggttaaagtgaagcatgacactccgttggtcaaatcctagttcgtcaacgatgtcgatggtcgcgtagtcgtccatggtccagatcgagctttcggttacttcccttggctcacctgggttgaagttgcagcggatgatgccattatttcggtagagttcctccatcgctcggggaaacccatccaaaatatacagcctattcttcgcgaattggaagaagctcctcgtgtttttgtcgccgctttcgtaaccgctctccaaatggcgctgccaagtgaggcacctatgataaactttgtcaaaggcgaccattgccctgtccggtgcctgatcatcgtcgagaacaaagctgaaggcattgggtggcataccggcaggctccaggtccattgcctcaacaagccagaccgccaacgctttggacatatcggatatgaacctggcacgtgcgaggcatatatcttcagggacctctaaaacgttaccgattaaattaactcgcctctcgatgcgaaggcaaggattctcctggcagaaacgaatgagtccacgagcatgacaggctggaaaagcgacggacttggagtcctcgcgcagcacgatctttcgaaaatgcgtccgttgcttgacagacagctggcggagaaaatgaatagctactgcagccgcggagaagtgatatggcctcgtatgttgactagaattcctccatatgccattatcattcctaatacctcgctcccaggagaaggcaccttgaggtggcatatataagctagctcgtagtcgctgcaatttccttttcgagggtatttcccaaggtgggtgatcaagagtgagtatgcgcaaggggtcgtcgtggggaggtagattcgggtggtctagctggtatctggccacggcagcgatggtttccctttccattgattgcagtgccaactggcatgtgagagctactgcttctcgtgcagaaaaaggcacatcaccccatagagcgatttcgcgtatgaattcccagttatcctcctcattctgcggccggtgttccttgatggcatctagcactggtttgaagagcggaaatctcgaagttgttttgtcatagatttcctttgagatcgcagggcgcaagtagctgaggacttcgaaacgctgattgtgaagccggcggagagtttgtgaatattccccagcatggctgtagttgcttgtgtgacagcccgtggtgaaagtgaccgtattgaactcgaaaggcagaccttgagtctcggcagctgtggtacgacacgtgaacattaaggaaacctccagcttttcttctggatcctttgcaacgagcttttgtttgtcgtgggaatagctcagaccacctggaagatgaaagtaaaattcgtagatttgcaagcggacctcagtggggaggctcgtaaaacatagtgatggaggcattttcgagagcgcttcagtcggatggtaaatgcttgtgagtgagggaatatctggggtggtaaagaagggacttgctccctctttatgctctcctgcagcggctataggagggttgtgagtggagggaggtgttgctgcctaagcctaccatcaaggttaccttgcctgactgacgtagcttccaaactctaattgtgttccattgcacaatgatacgctgcccagagtagcaaatataccatttgcgggttgattcatgcgtgtcgtgcgtgctgcatgctatcagaagtacatccagcgcgctctcgcggccatatccagaagggggacgaagatgttgctgcatctcgcttaagtatacaatatttcatctaggttggatccgagttcgatacctaaattggcgaaccattagagaatagagttcatcagttttcagcttggaaaatgttcatcatcattctcgtgtagttggcgagagccgttgctgccccacctcgaatccttggaggtttagtggtatctgccgctaaatggccaaatttctgaccgccaaaattttcagattctgccgcctccaaccttgaacaaaatccatcgcagccaccttctttccggctgcacagtaacaaactctcctggaaaacacgtgctgccactcctggcgattgcgataaacagggtctttgaggatgtcttcaatgcgaaatgccatccagcggaacccccacagggagcgtgcccagccgctggagcgccgacgtctcggtcttctggagaagcacaaggtcagccatagcacgataatcctgggacgcacgaatgcttgctaactcgcgatttcaactgtataggactactcgaagcgagcacaggactacaacaagaagaagaagcagctcaagaacctccgcgccaaggccgccgagcgcaacgaggatgaattctacttcgggatgatgtcccgcaagggacccggctcgaagctcatggacggcaagaggtggagcggaacggtgcagggcgaccgcggcaacaagtctatgagcgtggatgctgtccggctgctgaagactcaggatatcggctacgtgcgtacgatgcgacagattgcacagaaggaggtggcaaagctgcaggagcaggctgtcctgacgaagggtctggatcgcctggacgaggatgacgatgacgaggatgaggatgatgacgacttcgatctgcctcccaagtcaatgagggccaagcccgcgaggaagattgtcttcttggacacggaagaggagcaagacgaggtggtgcaggatagactcgaggaagaagacggccacgaagaagaattcgagggactcgacgatgaggaggaggaaggggacgaggcagaggacgagagagaaaaatcgctacgaagggtacggagacagcttgaggctgccaagcacaagttgaaagttctgacggatgtcgagagggaacttgagctacaacgggcaaagatggccaagacggccacatccgggggtgagacaaggagagggaaaaagctcaagttccgcacacgaaagaggtaaatgtgtgatccaaaagcctttatatcagcaaaaccagtctcctccgcccacgatggcagaattaatacgaattttacgacttcattcattcctcattttgacacttcctcacgtttgagatgcagaatctagtaaatgttggagcaatacttgagccagacggtttctactctggctcgtttcattttctcattaaccctagtacttggacccaaccacgccataacagcagcaaaacatcgcctttaaacaaccgaaaatctgtgtgaatatccatatcaaagccttgaacgcccaccgagccagtttcgccgggacccgcaacacaaacggcagcttgtccagcccctccttcaccttggtgtccttcttcttcttcttgtccttccccagactgctgctctggctctccagatccagctcgaagacctcgacgggccccttgttcttcttgccgccgaacgccttgccgaagaccttctccctgctgctgttgctcttgaggaacagggtctggggagggggcaggacggggggaggctcgaaggtctcggccacgggctggttcttctcgtccgcggaagcgacgaggatgagcgccgtgatggccacgtcggcgatgtagcacgactcgatcttggaggcgagccccgtgtcgaactcgagccagcccgcgccggtgccgtcccgcgtcagcttggccaggtgctggggagactcgtggtgctcgagcgtgtactcgacgcgcgaccacgccggcgaccggtcaatggtcacgcagaacggggtcgccagggcagggtgcacgaggaagtggctcgcgctgtcgtcgtcccagaccagacgtgcgcattcccgctcagccaagtagacggcctgggggtcgttggccttctccaccgccatcttggcagctgcccggggcatgaggagcgtgacaagcccgtcattgggacgatgccggcgagattcctcctcgagggtcgtcgtcagagcctcggtccagtgcttcccatcagtaatcttggagcccctcgggctgctattgcttccgccgctcacggcagacagcaagctgttccccgagatcgggctcgagtctcctgttgggtccttgtacggcttgttcgggtcatggcgcttgaccgtcacatacgccgaggcggaggtcgggtcgatgcgaatattgtagaatggctgggtggacgaggagagcgtatatacaggtgcgtccttctcctgctccagcttcatgcaatatacccgcccctctaggggagtagccctccacccgttggcaactctccagaaggacttgagctggctcgttgtgcaggtctggggttctacgggaggatccctgggcagtggcacggcatgcccccacctgggatcgtcctcggaacctcctcgcaaggggctgcgggtggtgacagggagcggaggctcctcctggttgatgccctctgagtcgtcattggggaagaatgactgcctgctgatgatggccctgggtatccctgcagggccgagttgcgtgggcgcataattctgttggttgaggggtatgttggggttgtaagtcgggaagatggaccgtacctggcccgacgatcctgcttcctcctcgagaggcggcttcgcgatggagcttcggtccgggttacgcaccaaccttgaagggtgttgctgaagaggatgttgcgcctgaggttgctcggctgctaccggtgtctgttccctgggcagtggtggcagttcgcgttgttccctcgcaggggactgtgtctgttgctcccttggctgttgctggtgttccctcgcgggcgactgcatctgctgctctctagataccgacgcctgtcgttgccgttgcctcggcggtgactgctgtggctgctgttgcgacgacggcgactgcgcctgcagctggggtgtcttgcggccgttgcttcgtggtggtgaggtcgccagcgacagctctccaggttgaggggtacgggtccgggcgctctgcggcgtccgggctctgcgttcacgggattctgatcgtcgagggcgcgaggcctgcccgactgttattggcggggtggagctgcttgggctggggaagagggagaaggcccccggagtaggagacgtggaggacatgacaagccaatgtgtcgagcgtgtgtattagagaccaagatgggcgaccagatatggcaactgattcaccaggtctcgcaaatggtttcaatgggatcagggggttaaaacgtatagagcagatatggaggaaaagaggaaaaagaaccagtcgtaaatcagcaacgcgctatcacagtatcatggtctgtcgttacgtcgttgagtagaatgcccgtgtaagagcaccggaggggaggagaagcgaggagtgaaacgagcaaaaaagccaagaacccaagagccaccgaatcattatatacgacctgccaggaacccatcgcagaggacccgagtgggtgccgtttttctccctaggagggcatccgctgggatgctacacctcctcttcgatggttgggcagatcagcagtgttaagcgccgtgcccgcaccacacggcgggctgcgaggttggagggcgggctctggctggccggtgcttggagacgggcagagctgcgaggtgtttggccgtggtgatggtggtggtggtgcggggcgctcagggcggaccgggctggcagccaatcgtgtggcccgtcacactgcagcttctgcacctcacagcaacatcgtccagggttgaggagggcgagggcgcttagccaactgccgcccttgttggctgcccggccagtaggatcgcccagatgactcttcccacccgtttctggttctatggctggctattcttagggttagaccggaaacctgctcccccacttctgtcaccacttcccgggccctggtctgcatcaaccacatgtgatgcctcgaactcgtttgccattctgctgcgcgagcactcttccgcgctgctgcgttgaagagaccggtgggacctgcgaaccatccgctcgctcgaagcctccatgcgtctcctttgcgccgccttgacgctggctcctcgtctcgccctggcggttgagtccgcctgcatgtacgctcacgcatcatgacaggagttgagttgtggtgcctggatctgacccccaaggttatttgtagatcccaaatggtcagcatcggtcattgacattgaatccgtcaccgacacttcagctcctaccctaaccgttgatggagtcttcctggtttggacggtatccacgtttccccatgtaacgtcctacctacatataggtatgtaagtgagtctttggcgggtatcgctaaccatgccacgggccttagccagcacggcatccaaaagcccgcggcgccaccagtcacggtcccaaacagccgccggtctaagtcttaagactcatgtacgtctcctttggaccgttttgtcgaggtccatacgcaggcttggcgctcagtttgccggttctgcaaagtcatcgtcagacagcacaccctttgataaatttgataatcaagtaggaggatgtatttttaaatctcgtctagaggaccgccaatcggctctgctggcccccaatctgcctattcgtacaacaaccgctatgttctttttttgccagatcttactatacacaccatcttctccccaaaaattaaaacgccgagtgaatgcaaaagtaatgaaaaaaaaggggggttccacacatcgtaataatgccgccgtcattccctaacaacgtaggccgccatttaccgcccgctgctggacgacgacgacgaggcctgcgcggccggcatcccgcccaccctctcgggcctgctctcgatcccctccggcttcggcctcgagagcctcacctcctccggcagggcccaccactcgcgcaaaaactcctcctgggcggcggccatccgggccttgcgctccctctcgcgctggcgctccagccgcatggcgaaccactcctcccgcgcggcgtcgtgctccgccggcgtcgcgaaccgggtcaggcacgagttcatctcgcggtgctgctcgcggcactggaaggagacggtgaaggtgcggccgagggcgcagtcggcaaaggctgttggcggactcttgttgttagcaaagcttttggtttgtcactaattgggaagggaagatcagtttccgcattacccttgatctcatccgagcacagatttcgtactcgggcgtagtagatgtctctgacttgtgactcctgggaggcggagagagggaggggatttcgagacgggacgccgaggcgctgtggagcatcgttggaggccattgcggccagggcgtgggctgggcgggccaatgacgggttcgacactgtagggcggggagagcagcgacgattgagggctgcgagccgtcgctggggacgagagcgggcgtgcgtagacggtgattgaggaacggtgtcgtggtggttgaggctggggagcttggtggtgagctttgaacgatcgcccgccccaaagaagcacggcagaacgctgaccgccttcctgttgtggattatcttgctcacaatcggcccatcacattattgcgagtgactccactggcctgcttggctgtttcgaggcagttcgacaattgccggctgaacatgccacttggacacgttttgtgttgctaatggatttgtgttatgtttcggcatgcaagccagggatctgagtcaacagtcgatcatggcccggtccgttggcctgggttttgagggacagtttcctcaccttcgtgtaagtcactttcaagttgctactgaattttgggtccgaatacgtgggcatcatgacccctgtttaaaatagagggagcagacaattcatcaaaaccagttgtaagagtgcagtgggccagcaattgaactctgggccggtgctgtcttccgaagaggctcgggtacaagagaggaaggaccctgctgagatgtggagtgatctggagcaggccagaaattccgtcctggtcagcaatatcagtcttgatacggcaccccgctcgtacctatgtcaccaattactatataatatagagaattggaatcatagctttgcaagcgacaaaaatcccagctgatatgatagttacggcccaatggtctcaccgtgaggcggccaccacacttacaccacttacacctatatacatggtacatatacgcatatcacagacacaaagaattgaattataactttttttcatcttgctatcatgtactattaatggatatgttgacatcaaaagggactggtatcaaaaaagaagccgcatagctcaaactcataaagactcctccggccccggtagtgtatgtatatggtcgtgactgtgtttctcccaccttctcacttcccccatctctcactctcgtcgctcctcaactcccgctctgtcaattactgcgggggagggtgaggagggtactggtactgctggggagggggcgattgcgcagggtagtagggattctgtccatcagcggcggatagctcactgctctgaggagggtaatagccctgctgaggctgctggccgtagagctcctgggctgggtagccggcgggcgcgggcgagggggtcgtctgagggctcacggcgggctggtagggctgctgggggtactggccctggggagggtagctggcgggaggctggtaggcggtctgctgagtctggaagtcgttcttctcgtagccgccggtctgctggggctggaggggctgctggacggggacgggatgaacctgagaagcggcctgaggctggttcttggtctccatctgcaaggcgggggcctcggtgtcgaagaggaagcggccctccttgcggcccttgaagaagaagaccatggtccaggtgaaggtggcaatgaagaggagcctatggcggtcccatgttagcttttgatgatggatatgtattctttgagaggtgcataccagacaagggcgccgagaccagcgttggcggacatcatggcctggccgctcttgaaaagaagagtggcacgggtaacgagggagcgcttggcgcaggtggtcgagttgatcaggctgccgtcgttgtagcatgagttgacgttgacgttgtaaacaaaggttgcgcgcttagcagcagtggcggcgaaggtagcgagccatagaatcatcatgaaaccgtcgagggcaatgacggcgatgacattgtagatcttgtgaagcgcggggagcttctcactcagaacgttgtaagcgacgacaatccaggtgaacaggccctgaaaaagacgtcgttagcattggtctcagggtgctggtacacagcttcatcacggtttcgacttacagtggctacgcagaggccatgcacgtccaggtaggcaccatgcatgagcacaccagccatggccatgataatgagggcgagcacagcctgagcaatgcgagctccgaggagccagatcggcgtctccagaatctggggtccgttctccatcttgtttgttgttacagagtatagcgtacaaggaattggatgtccagctagctgcctataaggatggagagaaggacggggaggggaagagcagagtccggttctatattaaatagaacgatcgacacaacaaagcaagccactggtgcatcactgcattagaggggacgccatggcattaataaagaaatccagacccaggtcatgggagcagccgagagcctgagatccgatacggaccaaggacgcaggccaatggatgggacagcccagaagagggcccaaggcagattttcagccgctagggactattgcagcatggactggaggagatgggatgcgctcgggcggagatgggaggcattgtctgaggcctgccgctctcccaaaacgtttactctccgcgctgctctgaagttcagccgcactgcggttgaacccacttgatctagggtgatgcctgacaagcccccctgttcgttgggaattggggagcgcgtgttgcgctgtcatgggctggggaacaagaatttccttttgcggcggccggtctcgacttggactgctcggcagatgctttgcccccagctcttaactccgcagcttgataacgagggctggattgcctttccatgcctcatcctcgaccgaaaccccagcggtgcgcctacggtgagcgtccgtctcccaaaagcgtggatagcttcttcagctgcagccaagctagtgactcgtgactggctggctggctttaaacttcatgccctgcgggtcgccatatccacggctcgttctcctgtggcgtgtgaagcgaaccatgaataatcccatatccagaggcgcctcgaatatagttaccgctggaacggcgccgaggtgccgcaggaacgtacagactggagactagtgatcgctagtgccctcatcggagggagggtcctggcggttgaagttgggtctaggcgtttttcctcgatgccttgtgcggatgagcgcagggccgagggctgctgcagctgcagtgaccggccgcctgtctgggccagtgctcgactatctgcaaggcaatgtaaccgctgagcgttggacagacccacgcaggatggcaatagactgactcaactgcgactctgtgacgggtgtgggttgtgttttctatctccaggggtatcggggctgctgtcacccagcttcgggctgaagtctggaaagacgtagtcgcatgatggttgtgcaaactgcctggaataggttaagccctcatctctctttgcggccggcagctaaaccagaacaaacgtggcgatgggtgaactcaatctggcgaccaaagctcagagcattgaggcctggaagaggactcgacttttccatcatagcatcgccggtctcgcccactgccgcccgtgggatctaccttgaccatgcgagtgtgtgggaacggtatttctactgctgccgatctgactgggaggtgcggaatattgcccgcagcccatgtcctctcgtcatccaatttcaatttacacacacgcctaaaaagcaggcacccgccgtggctgctgctgtaattaccagcaagccccctaatctccaccgcagacgggctatttccagccagagcagcggcccccccccccaaaaaaaaaggcagattccgcttgacaattgacactccttccaacaggcgagaaagccctacggacgggtcccccttgaagcaggtggggtgcagatctttgcacgtcgcattggtcgaggcctgtgagagcgagcgccggagtcaatgaatgtgtgatctgtgcgcggcgagattcagatgcaaagtcggatgaatgacccgccccatgctgcccgataccacctccaggcttactatacccatctacagctagcaaccaacacgcacagaggcgttgacatgtcatatgcagcagtcaataatatgttttcgatataaatcagctcggtctcgatctgactccatgatgtcgcacctgcatcagcctgccgccaccaccgcataattcgtatacgccgtcgctaacacacctcgttttcttcccagttgcttgccgtgctcccgccgccattctctcaaaatagacacgaaaaatagacaccgccccgaatgcaatttcccttgaacacaaaaaaaaataagacaaagagggaacattttaataacctgtaaccatccacggtaagatgctgggatagagcgatggatcccctctagatcttctcgttggggccggcgatgagcaccttgatggcctcgccctccttgaccttcttaaaggcctcctcggcctggtcgaagctcaccacgctggtgacgagcttcttgacgtccaccttgcccgcggccaccaggtcgacggccagcctgtagtcgccggggccgtagcggaacgagcccttgaccgtcacctccttgaggcacatggccatgatggggaaggtgatgtcgggcttgcccatgccgccctgcacgtacgtgccgcccatgcggacggtgtggatggccgcctggatggacggctcggcgccgctggcgtcgatgaccacgtcgacgccgtccgggaagccggcgagctcgcggatggccttggcgttgtcggccgcggggatgcgctgggaggcgtacgtgtgggtggccgcgaagccggcggcgaagtcgagcttggactggacgatgtcgacgctgacgatggtggaggcgccgtgggccttggcgacggcggcgcagagcaggccgacgggtcccgcgcccatgacgacgacggactggccgggcgtgacggaggcctggcggacgatgtggacggccacggccaggggctcgatcagcgcgccctcctggagggagacggcggaggggagcttgtagcagaagtcggcgggcgaggaccagaggccggtgagggtgccgtcgtaggggggcgtggcggcgaaggccatctcggggcagaggttgtacttgccggccaggcagggagcgcaccggcggcaggggtagccgggctcgagggcgaccttgtcaccgacggcgagggtcttgacggcgtcgccgacctcgacgacggtgccggctgactcgtggcccaggaccatggggtccttgactacgaagtggccgatggcgccgtggagccagtagtggacgtcggagccgcagatgcccgtgtagttgacggcgacgaggacatcgtggggggaggcgagggatggcttggggcggtcctcgaatgcgacctcgaggggcttcttgagcacgaacgagaggttctgcaagacagaaagaaaagagaaagaatgttagcctgtcactcttacgcgaaatccatgcgaaaacaataattcgggagtgaattgcatacgctgagctcttccttgttgagggacgccattgtgtcagtgaggttggtggaacgaggtggtggtgacgtcggaggaggggcaagattgattacaacaagagtcggcaattggattagcacggtactacaagagaagaagaaaatgaaagggggagaagagcgatccaagcagaggaggggagggactcgtcggcttatgtagcaccccctccattatctacgtccgagtctcatcaacacgacctgttctgaagtctctctgtgtctgtgtatgtacagctaattagctaccccacgagcttggtcttgtgacgcggttgagactttccagggcctgccagtcgttgactttagaacgggccgctgtacgagagagctccgatttagccaggctcattacccggcccaataggagctccgcgaaaacaggtggagcagccgccaacccgcgcgagcatctcgagatttcagaccttttcagcgggttcctgatagcgaaacggggggttttggacgctgtcggggacttcgccgacacacggtgaagggccaatccaatcagagagcttgtttggaggggcgacttcgatccggctcgttggagcggtcgacattgcaccggctggtgagccagccatcgatcgggcgcttgctttctttttctcgtctggttttgccgttccaatagcgaatgccatgggatatgtacataagtatcaggcgcgcattgatgctagcagccggttgcctgtagccggtttggctgtaaccttgccatgcgggtagcaacgcttcaaagaggggagggagggggagctcccaattgcacgctcctcggggctcctcctctcaatcgatttttatcaagctagtatcttgcactctatcgctatgcaaaatatctagctagtgctggctttttaaccggatggcttgtgttccatattttcaagcccacccactagcgaagtcccgtcatgaatcgttactatttcccagatttcccactgcactgggtcgggaattgacagccacgggattgaggtgcatgcatggaaggctggtatctacccggagctgtgagactgcccatgcgccgcaacgtgggatgttgcatcctcgcacttaatccccgcttgatatcttcccgaatcatttatgcttcgatgcttggcacgtacctgttatgagtattttttttttttaatcacaaatcgcgatccatgcccaaaacctttactcaaagaaaaatgattgaaattaatacatcccgcctgggcacaggcatcaaagcctgaagaaccaactctaagggctaggccgatatctctggcccagattctcccgattgaattacaaactgtatagttcaacactggatactgacattttcgcagcaagctgaagaaggatgtggaactgtgagcattgcacatcctcgaaggtcgtagttgagatgagtgtattctgaaattgaaccgaaactcgagcttgtttgcatggcttcagctcctcaggcagctcactgtcgtcggaagagagcgaacgcagtgcaatatacgagcagaatcacatatcgcacaacttcatgaagatattctactcttcaatattttaccccatcttgtcggtctttccatacttttcctcatcatatatttgcttgttcatataatctctttgtcatgtatatcttcattatatatcttatcatatatttcttcgtcacatgttcccaattatcatgatggctgattatatgaccgccaacgtccataatttacattacatgcaatatccataaccctttttgcatttatcgcataatgtgagcctcctggtggctgatagagtgcctcttgtgcttgctgtcgtgaggaaagtcgtgctcaatggttgggggacccaagtgctcctgcatcaccgaggggggcacacgggcagcgtccaagggcacttggccatgtgtcgtaccagtcctggagaaacaagacggtcagcaatcagtcaaattcacttttcagatcggtttgtggtgctacttacaatgtgtgatcggctgcagtcctgtccttgtgctcgtgaacgcgggggtcgagcttgttcagcatctcgctgttatggacagggccggtcttgatggtgttgtgttggtggtggtggccgctctgagcaggaacgtcgtgtcgccccagggtgcccgagggcaaatcatgtctggcgtgatcggttgggtgaacattctcatggcggatgttgctctgagcggggacgtcattgcgtctcaagttgtcagaagccaagtcgtgtctgccgtggccggttgtgccgacgttctcatgacggatgttactctggacaggaacttcattttgcctcaggttctcgtggcccaggccatggttggatcgaccaatgttgttctcgtaggcattgtggacgggaccagttccggctgtgctatggccctggtgagggacattgttatgaataggagcatcatgtcgccccaagttgtcagaggctaggttgtgtctgccgtggccggttgtgccgacgtttccatgagggatgttgtgctggacaggaacttcatctcgcctcaagttctcgtggcccaggtcatgtctgccatgactggtccggccaacattgttctcgtagacgttctcctggtaccttggctcttcgcgaaggttaccttggtggaggttctctcgatgaggagcggtggtggtggatgtgggctgcatgttctcagtgtgatgagtcttagacgagcccgtgagcttgtttagaagtgaagacattgtggtgtaaatgatttgcaaggtaggttgtgaagtaggtgaagagtgttatgagtagagtagagaaagatgtgagtctcgaatagaacagtgccttaaatccgagaccctgaggcgttatatatacttgcttgaagatatcttgtaagccaccaccagtcagccattgtgcaatcttcacgtatatctctcataggtgctgtgccatcttacttcatcgctcgtcatcgatggatccaatcgccagatcacccccacccgccgctgcctagatacatcacttctccatcagtgccctggaagaagccgaagatggtatgaaaatagagcagttttaagcttaaacgctgccgaactacaggccccaaggtgcttggtatcaggttcgggatgtcattctacgtcactggctggaggtcaatcgccggtggcgtgggcccccatgacgttgatgacttccgcgcggcctggagccagccaaccgcccccctgatctgccctgatgctcgctcccacggcccgggctgtgcacgcaagctttcaggggatcttggatcactgatcccttggcttttttagatcaaatcgaagtttgtgtggcgactcgcgacttccagccaagccagcttataggctccgtcccattgtgggggcgaagcttaactacgacgctggactgaaagctccgtgagacgaggggctttgtagcttgatgggaaatacagcacattgtgtagtcatctttcgtcatgtggggggtacggccggtatgatcctcaaataatcccttccagagaccagctgagtcgggacggaacattgcctgccttgctcagccttactcttggcccccagccaaccagagctcaaagctcaacatcgcaccccaataatccataaaacccatgtgatgccctaataaagcaagctgaattcgtacccgatccgtgttcaaaagtagcagactaaatcgtaatagaacctcgtaaagctgaaatgatcctttgccaaacgccagcgcctacacaagacatcggccccccccccccccccgtagtagtgtttatacaagatatgaacatagtacacccgtggcctgacctcccccccccaaacatctatcaattcctccgtatcagcgtccacagccccccgcccaccgcaccaaccccgacaacccatggcagcaccttccacgccgcctggtagaagttctgccgcacgatatcccacgctatcctcttgagcatgtccgcctcgttcagccaggggaactcgacgtccggcacctccttgcccaggaactcgcagagcggctcccacccgtcgcccagccggtactcgagcagctgcgccggcgggaccagctcgcggatccgcctcgggtgggagaggtacgtctcgcgggcgttgcggcgcgcctcgtccggcgtgcgcgcgccaaagagcccgaggatcatcttgcgggtcgccttgccggcgtcggacccgatgagcggctcgagggtgccgacggagaagttgacgacggggttccacaccagggggaacaggctgccgaagacgctgcggtgccagcgctcgtagttgcgctcgacgagcaggaccttggcctccgggtatgcggcgatgagctggggcccgaacatggaggcggcgtcggtggtggcctcgcaggggccgtacagctcgtcccactcctcgcgggtgaagggcacgcccgtgtagccgggcagacagtcgaaggtggcgtcggccgcgcggttgaggacgcgccagtcgtccttggccgccttgctgcagtggtggacgttctggtagccgaggatggtgagggcctcagcgatcgaggtcgagcccgtccgggggaggcccaggcacaggaccttcatctctctcttgggctggggctcggtctgggcctgcttgggctgcgaggacgacatggcttgctacggcctcctgctgctgggctggcaacatgcacctctctggggatacttgggaggatggtgatggaagagcacgtcttcgcacagcagtcaatggtgaagaaggaaaagaagggccagcagggagaccgtgcagctttggggtaggcagttggggacccccctcctgggaggttggcggtattgatcgaatgacgctcttgatggaaatgggtcgctccaaacaggtaggtattagaaaagggaccagccagctaagaatgggccaatgatttcctgggctttcggatcgacctactctatcttgccgaccttgcccagaatggaggcttgagcagcgatttcttcatggagcggccgctcgggagggaagggaagtcttggccgaagttccgccgcacacaatgtgatgtgataattccgcattgttggctggtgttatagcacggtggctacaatataagcaggccacatgcagggtgcaggcccctcacatcacgggcagccgacggtgagcgggcaggagatgggattctctttgaatgtccatgaatcgggtcaagataccccccgaggtgagatgcaggaggaacaaatgaggtcttattctacctacctggattgatcgccagtgcgcgctactgagcaggggcctgtgccattatcgcgggtgcttgttccagcggcagggttccggcgggcgggtccatttagctccctgtgcccctaatcgccagccgccagttcctggcccacagcggtctagcttccgctatcgacttccataggtagctgtctggaactcagcaccaagggtcctatccccccagtatgttggcagttgacagctgaggccagctcagcatgtcaattctatcacgtgagcctcccactggtgagtacgggctgggcgatccttgtttcagttcctagccctttggaatgatttggttttgtcttgggtacctttgacatgggtttcaagaacctggatattacggtagttcatgttggtgcctctaacttgcactcagtacatatcttacccttgatgagatcagcctcatgttgacgatagcctagatcttgtatatttccaataggtagtgtcaaatcagttttatcagatgtcaactcatcagctgaatacatggtaaccaattggttcgacagcattgctcgcatcgactaaaactggatgccccgagtttccgactcgccaatgtgaaacatgccgatccggtcctcagtatccggcagtatgacatgattgcatacagattttcttgttgggctattttcaccctcccaccagttcccgtgtttcctaggttgtctatagcatggatggaacacaaaaacacgtatgtcgcgaagcctctcgaattccatcacttgcttgcgagcctcaggcggtacggggcatatgagtgagtattcttacgatggtcatgggttataccattctcgcttcctctagtctagaaaaacacttggtatgtcaggccacgtccggggagatcatcagatacctttagaccgcatccgaggatgatgaaaatccaaggcttgagagtaaaaacacttcagcacctttctctagtcatagtcctctcagaataccttgggaagaacataaatttctcgttctctgcctactatacatttgatgggtgacaaaactatagtgagacgagatatgtagctaaacatcggatcgcaaattcttcgagcatccagatcatagcgatgtagttcctactctttttggggggatcccgagaaggcgaaacagcaaattaactccctgttctatgaagaggagctccatcggctgggaatgtatcttgttgaaggtgtgaatgcttctaccttattctcccttggttgttttgcttttgctgcttcattcgtggtggccattgtatggtcgatagtgaaggaggacgtccagggtggatttgccataagggcatatgtcctcacctttctcctctttgtcggaggcgttaggaaagtaatcatacaataagatcccatcttggtttaattgggtaggaggcaattggcagagttaatactgtcatcttggctggatatcaatggagtaacacaaccgagaaaatattgggtatcgattttcgcagaaaggcaagcacatgcttgatatttagaataataatagcattgtggcgattcaagatattattgtggcgattcgagaaggtgagggcgtcatctaatacaatcgccaggggtaggaaaagcgtcggcgatatcatagatcacttatatagataagtatcccatgaatacatcattcaacctcaaaagagtaggagcataaattaaggtaccttcttggtgcggcatgagtggttgaatacgacgaagagtgacattgaaagtgttttgcataccaccatcgtcactcacagaataggtaacattcatctctcccaccaccaataccataaaattattcctcataaaaccactcaagattcctcccataggtggtttcttttcgaaaatggttacttctcgatgagagtaatatgtggacggaataatttctactccaactacaagcccgtcgtaggctaaaggccaactgcaagacagggggcctgttgacttactattttgggctaccaacatagagttaagtgaatagtaagccctccttgacgagagcctgcgccgtgtgtgatgatcggttccatagccgacaaggatcaatccgacccaatgctgcaggttcagcgtccagcgtcgtatttccaagctccgtgtgcggagaaacctcaaatcagccaaaattctagactttttcccccactaccgagccagtgagacgcaatcatatattcccttgattcctgagcaggggggacagagtaggcaggatgagcaactaacacagcaacgatggcttggattttgccttggcaaagtatgcatatatatttatcaaaagaagtggaaatgaaacatcacctttctagaattgatcaagtatatatctgtgggtttgttctcaaatctcttaagctcgtagatgaaccgattgtcgagcctcgacacatatacttaatatggacaagttcaacaggatgctaatctcgaaaccacttcataccctctcgctatgtcttggactagcgagtgtcttatctgcgagagcgatcggttcggattcccagaatatccagaaaagagaccaaaatgtcgtcacctttgatgaccacagtctcttcatcaacggcgaacgcctcatgatattcagtggtgaggtccatccatttcgcctaccagtcactggcctatggctcgacatcctccagaagatcaaagcatccggatatagtgtcgtctccatctacatcgactggttcctcttggaagggaaacagggtgaattccgctccaaagggatctttgcctatgataccttctttgaggccgctaagaaggccggtctctatgtcattgctcgtccggggccgtacatcaacgctgaagtgtctgggggtggatttccaggctggttgacccgtgtcccaggagcacttcgtaccaattccgacgccttcatcagtgccacggatctttatacaagcgaaattggcaaggttattgctgccgctcagatcaacaatggcgggcctgtcattctcctacagcccgaaaacgagtatcaaaacgccatcgccccttatcccatgccagagtacgattactggagcagtgtgaccaatcagtacaaaaaagccggagttgacgttccgtatttcaacaacgaggctcatatgtatggatatattactgctcacacgcctgccagcgtggacatctacggccatgactcgtacccgcttggattcgactgcgacaatccggacgtctggccagcaggcaaattgcccactaactggctggccaccaacgatgctttggcgcctgattctccctacacaatccccgaggtaagtcaacagtatcctttctgaaataatgttgaggtcttttctaacaaaataccagttccaaggaggcggtttccaacactggggccaaacggctgggtttgaacagtgtgcttctctactcaacatggaattcgagcgtgtagtctacaagaacaactatgctgtcggtgcaaccattttcaacatctacatggtatgtctctgattctctcaaagttccccttcctatctatgatctttctgagattaacgtgctcagacatatggcggcacgaactggggaaaccttggacacgccgagggcttcacatcctatgactacggtgcccaaattactgaggagcgtcaactatggcgggagaaatacagcgaggtcaagcttcaggcgcacttcttccatgtctcgcctgcctatctcgaggcagaccgcttcaactcatccctggaatacacgaataccgacgccataaccgtcacacctgctacaaccaacactaccaagttttacatctctaggtaaggcaagaaaaggctaggccaaaccagttggaacaatcctaatacatgtaataggcatacagagtatgagacgacagagtcagttccgtaccgtctcaaggtcaagacagtcgattacggagacattgaaatcccccaactgggcgacagtctcattatgaaccgccgtgactccaaaatccacgtcagcgattaccccgtaggagacaagaagctcatctattcgtccgccgaggtctttacatggtgtgtaaacctaaacattcactcatcacttctatttggcagtttctaacagctctgtaggaagaaatatgatgataagaccgtcttggtattatacggcgggcccaacgagtaccacgaggttgccattgcaggtgaaacagagatcaagagcgaggatgtggaagtgcagagcggcgatgtcaaggttcagacctccgacaagggctacacaattctctcttgggccatctcggacaatgtcaaagatcgaagcgttgccctagtccaaggagacttctacatctatctcctcagttagtcacagtaacccgtttacctacttcctcaagctaaccattgtcccttcttcttctcagaccgtaatgaagcatacaacttctgggttcctcccaccggttcaggcaccgacttcggcacctcagacatcatcctcaaagccggctacctcatccgcacagctgaaaaggacggcaagtcactcagcctcgtcggcgacgtcaacgccaccacccccatcgagatcatcggaggcgcccccgccagcctcgaagagctcaagttcaacggccggtccctcgacttcgaccaaaacccgcacggcgtcgtcaccgccaccgtcgagttctccaagcccgagttctccctcccctgcctcagccaactcgagtggaagaagatcgactccctccccgagctctcgccggactacgacgacagcggctgggtcgacgccgactacaccacctcccccaacgacctccggcccctcgacacccccgtctccctctacgcgggcgactacggcttccacaccggcaccgtcctcttccggggccacttcaaggccagcggcgacgagtcctccctcaccatcacagcccagggcggccacgccttcggcttctccgcctggctcggatcccacttcctcgcctcctggaccggcgagaccaacgtcttcaacggcaccatcaccgccgacctgcccaccgacctcctcgccccgggctccgaccaggtcatcaccgtcgtcatcgaccacatgggcctcaacggcaactacgtaatcggcgaggacaacctcaagaccccgcgcggcatcctctcctactccctcgcgggccaccaggcctccgacgtcacctggaaggccgccggcaacctcggcggcgaggactacgccgacctcgcccgcgggcccctcaacgaaggggggatgtacgccgagcgccagggcttccaccagccctcgcccccctcatcgagctgggaagccggccgcccgaccgaccccgtccccgctccggggatcaccttctacaccgcgtccttcgacctcgacctgccgaggggctacgacatccccctctccttcaagttcggcacgggtgtcgcagaaggcaagttccgcctccagctcttcgtcaacggctaccagttcggcaagtttgtgcctcacatcggcccgcaggcgaggtaccccgtccccgagggcatactcaaccatcgcgggaccaacaccctcgccatcacgctctgggcgatggaggaagggggggcaaagctcgaggggatggggtggcatgtgtccatgataaccgagtctgggttcggggacatcgaactaacccctgcgccaaaatgggaagagaggaaagacgcctattaggtaggggtggacgatgctgtcaagtacgcaagaacttagttttagattatgaaaaccgacaattagactctaccgttttccacttgtacggtggcatcacgtcacaattggaacgaaatgagcaggtatttgtgtgcaacgagtgttttatcataatgatgtgtgtgttttttgtccggggggcaaagtagccattacaaattgttaaatatacagccttaaaagagagaaatcctcggtagagttgtcaaggtggcatactcgcaacttactcgaggagaaaataaaaccaagaccaacaaccttgaggttatgtttcaatgactttccagttcgccatatgcaagagaagaaaatgaagtaaaaaagccattaccaaagtcgtaagaccctatgagatccatcgtcaagacgcatagaaagaagcaaaagggtggagatatcgcggccacattagatgccgcgaccaccagtcatgtcattaattaaatgagcgaatgcacaggtccgcgtactagtgacgtattttagggcagtgaagagacaaaagaaagctcactcaaagtgagttagatgccaggaaatcggcagtcttgccagccaggtcaggggagcatgtagatgatagatagcttacagagattaatgtaatctctcttggacatggagtattgctgcatagccagcgcagcacttggtgttcatgtcatgtttgcaccatgggcacttgatagacatggagatggatccagcaaattcgttatgctcttccaagtccagcatagcttcggggtcattcattgccgcgtacaagttgcttggcatatcatggtagcacttgcagcagcagcactggaccagcatcttcgcaacacgctcaccatgaatactggcaggtcgtactccgggggatgaatcagaagatttgcgtgatgtaggtggcgaggttgccttcacactgggtggagcagatgggatgggggagggaacaaccgctgctgacgccattggcggtgctgacagcgctggcgatccaggcatcttgggtggcgtcttggactctttaactggcgcggccttgcgcgcagcctccagatatgatgcaggccaaggggcggcagccgaagattcatccttggacatgatcaagtcgcggagtgccggcgcattgtcatcatcggccttggatttggatgccttgatcgatttagccttgttggcttccttttgctggccattctgctgctttattcttgggatcagaaccgattgaacactcgacaccgactcggtgcgtcgacccatgcctgggcgagtgggcgggggaaggtcagggaacgcggccaagaccttcatagcagcggattgaacagggttcaggtcaaccgcactgccgccactcgttgaaaaggccggagaatgggggcgctcaagcgctgcccgcgcctcggcgacgtgatcgaagccatcaactctccctgaccctggccgggaggtgtcgggagtgcctgccaccaccggggagcgtataccatctgaataggagtccgcggaggagttgggagcaggcgcggcggttgtcatagtcttccggcggtcgttgatccgctttgggttgtgtagtgtctggaagttggagaaggaagccgaccgcatttcgagatccttggaggaggcagtgaggtagggagagttcttgtgtcgacttgtagggcgactctgcgacgtagcaagtaaggtagggttcggcggtagaggaggatgtgcggatcgtcctagaacagaccgagcagcttcgaagagaccacgactgcctggtcgcttggaagttgtgccttcggttgcgatataaggaatgcttggaggatcagatctcttggtgcgactggcgctgcgagcccgcgtggcagagtcgcccacatatctctcggaatctgttggaaatccagtttgtgcacggcggggagccattggacggggcgattctgttcgaggggtgtctgtaatgttcaagctcgccatcgaatctctctttgaaactttttggggagaaggcggcgacggcggggcggtagtgaaggacgggggactatctatctcggagtgggaatcgtccaattcgttgttaatactccgtgctaagggagacgacgcccgcgctgcgttgggcactgcgggggccagttgctgagagctcgcaggtgacgcagcaggcttgtccgttccattcatctgagccatactagggctgtacctcatctggtccgagggtggtggatggatggctggcgaggacgcattccgatgagaaaagacggtgcccaggttttgatcacgctctgtggatgaggatttgtttagcgtttgtggcttgggctcagatcgtagaccgaaatgagccctccaacggctcattcgaccttcaggcatcgcgtctgagttctggggcaggagaccctgggccgtggcggatgtgcgtattgagatcggcggataggcccgatcttgtacttccttaggcccagtcttgggcacaaggaacctgagagggctggatgagcgcttggtgtgttttctgaacgctggatggatgtcgccgctggcaccaatcgcttcctcgttaagagctcgctggtacgcaacaaggcgctggtgctcgagcttgatgcctccaataaagccgccgctattgctatcaagtgacggtcggtgggactcgaagggtgatctgaaaatggaagagagagagttggaccggatccgtcgagtctgaggcggtttggcgtcaagtgctgctggcgaagggagagtttgcttggcggggatgccgatggtgctggcacgacgggccttgttagtatcctccggacgctcttcaaacttcacagtcctggtctgggcaggttgctggaggggcaaggttggctccgatgctgaatgggaatgcgacagcttgctagggcgcggcggcttcgtcttcgaattaggcttggtctccttgtcgatctgctccttgccctgcttcttttccttcttgcgtctggcgtacgcctcccagctaggcgactggcagatagagttccgatcctctgcaagagaggcagcagcaacgacggtgctggggtttgaggtcagaggctgctcgtggaaggtgaccgtcttgggaccagtagcaagtttattgggctggggcagcattccagtagaagaactcaaactgatggtctgcacttggacttgcgcttgccccttgggcctggccttagtcttagagtgaacggtggagggactatatggagccggtagatctgatttaaaatcggtactggcggtggtactagtggtgttagtgcgaggtgtagcgcctttgacatgggtactaattttgagaggcgctggcctcgattgctgcattttcagctgcccagacacggattcttcaaggaagtgcttgcgctgctccgccgagtattggcgggagtgggttgctgttgggcgaggagcaggcagcatcggcgtgcttgaggggggctgcatgatcttgggagaggtgggcgatgcacggacagcgtgccgtcgttctagctatgcaattggaagagaaggagacgagtcagcatttcgggacggaatgagaggaatggtgagaatggtgaggccagttggcgaggtcaagcattggcaagcatacatagcatggcgaagggggggcgtgtgcggatcggatgatcatatcgtgatgggaaaggcggtgttgaccgagatgttccattcttttggaaacgaccagccagatgcacgcatcgatgccatgccctgggcgtccaggcttggcttttctgggctggaagcttggccggacggggggtgtttgggttttgctgggaatggacggggggactgggggtaccgatatgggaagcgtgatgaccgcagatcgatagatggaaagaatgtaatgaattgcaggcaggcaaagcgggttgggccggggctgaggaagaggcaaaacaagacaaaaccagccagggcaaacgggacgggcaaggcaagacaagagaggattgggtcaggaaagacaatgcaaaagagagagcccacttactacacactgcttctccagctcgagcatgcgctggaggctgttggagcgggctggccgggcctgggcatcccgccggcgctccttttgctggcgcttgttggtcgctagcattgtggtcgtcgtagtggtcatagtggtcatcgtagtggtcgtagtggtcgcagtagcagtggcagtagccgtagtcgtcgccatggtctatggggctgccacgcagcaatgtcccacatagagtgcatacgagaacggaagtgtggtcgtggtcgtattagccctcgcaccccgtccgctctgaagggctgtcggccactctgggtctcaggcgaaggcggaacccgatttccagaccctcttctattcttttacccctccgggtcggtcgggcgtggaagtcgcagagctccagccttcaggtctagcccaattgcccccactggcggtcaggggttattcgccgggacgcttggcccgctccggatcccctggcctgaagctgagacagctggaatacgggatcgagcgttgtggacgttgcgaatgggagagatgctgtaagctgaggccgcggatggctaggaagcgcccagcaagacgcaattccggtggcgcctgtgctgatcgagccagggagtagcaataaagtacctaggcgcgcgctctgcaagccagctcaagccgccaaccaggatttgccggctgaaagggcttgggaggccaaaattagccgtgcgtgattggcggtcctgggcaaaatgactgctgaaagatccccagaagcagcgtcgcagccccagaggagtggaaagcgagcgactagctcccgtatggtaatcaaacaaactgacgtcgctagtccgagatcagccaagttggctggagaggcaatcaaaaaccgttatgacggccccccgggtgaggtcggttttggcgggtggttgacaaggagaaaaagtcgacggcgagtttcaaagaatgagggatgcacaagtatcgggtgccgagcgcgacgggcaaaacaatcgcaaacagaagcataagattaaagggagcgaaaacaagggcattcgcacgaagaaatgcgattttgttgcacaggcaaggattggggttgctgcacaagctgctgccaatacgaggtttggaggagatctctgcgctagctgctacagccagagggccctatcgctgtcgcttaggcggcctagcaccacactctgccgccatagtccccgtataaggctcatggtgggcatcgtattcaccctatgccaggccttggcggcccgttttgacggatcaatggtgcagcaccacagaaacaagtccgctgctagcagaactcctcgcttgcaccacatcacatcacgtcaggaggacggcgctgactcgttgatgcgaattgcttcttgaccaactaggcacagagctaccccaaacaggccagctatcggtgcaggccacgactagtcaatcccaagcccaggggcagaagtaatccggcacgttcatgtccaacccacgacattgatcagcacgcctgcagcaggccgtggctagtggcagcccgcgtctggcaacttggatgcgctggcacccgtcaaagccacagctgttctgtgcttctcagctcgccatggcaggcagcggcacattattaggtttgcctagcacgacatatagtatgcggatgctgaggtgcgtgcatgtatgtaagatgtgcactgcgcattgtgctgggccagatgacaatgacagacccgcggaaccaccaacagccccggatataggatataatgctcacaggcggaaaacacgccattgccattgcgccggtggatgtcgctttaccaacatgtacgtcagtttcaatggctgacatggcatgatgcaacgccgtctgcatgctcgtatctggcaatcggatgacaaccacccaggttatgcatggagctgagagggcccaaccctgttttctcaagtccgttcgcattgtgccattgtccgcatcgacacaccgcccaattaaccaccctagatgcggtgggcagaatacgagcccagtctctggatccagcgtctggggagcctttgacacgcatatccctttctgaggttgactacacaaccctctctgtttggtagatggttcagctcttatcgatctacggcagggacccttggtggcctcctctctatcccaagctgggatttcgcccgagtgggggagcctcgggagtgagcgcagaaggctagaacacacgaaaaaaattcccccgaagttccagccctggcccaagctgaccaacctccgagctcaggtaagctcctgcgaggccatttcaaaaccctcggtttgcccgcggaggccatgcacccttgtcgcctgaatagatctgatcgtggcaatccctacaacacgcgtcgctacccctgccccagcaaaggttccttccgctctctctcgaacgcatatcaagggtgctcgcaagcatcaccttcgcatggaattcgtccgcggcggggatcaggaagagcatctttgcgcaaccctgaaacagatctggtgcccgtagctgctgcaccggcatcagccatgacgacattcagcctcgccgccaacttcggctcccgtcccaggctccccgccagtgtctgacggccaggtcgaaattcgatggaatgtgccacaaaggttgcccaacaacctcctgcattgcacttctgattgggccggggcctgaaggggggtgttgccatgctgatctccctctaccctccccaacaacgctgaatcaacccgctcagtccccgttacatctgtctcagacatgcgggagagcttaaccccattgactcctttttgcttcttccagcgctgaccgtctctctcccaaacgaacctcattcccgttcgccattggcagactattgagggctgccgggtgagccaaagcaacacggtgaagctgcctctatcgtcagctgagcagggcggttggacctcttccgcagcaaaccgaaaacccctcttgatgcaggctgatgcaaggtagtttaattggcccaaaactaattgctgcctgtgcagcggccggtgagtagtatatttatgaatctataacacaagaccaagacatgcatagctcgccagaagttgcgcaatatgcaactgctccattttattatagaactccatataggtaggtacctaattttaacatttaggtagtatcgacttgacccaatagcgggctttttaagtacaataaatggctagtactacgctgtggtgttattgcattcctatatttaaaataagacatgtatgagtgagatcttgcatcatcctgagccgcttccgtccgctgccctgaagccctgcgccaacatgtttccgagcgtcgcacaaaggtgcctcccagtgaggatattacccatagcgtacgctccaaagtggactgcctctacagctgcaggcttctctgaaacattcaaatttcaaagctcagtcaagactcgacttggcatggagaattccgtctacttatccgtggctggaaaggagagagcgactacggcggaaacccatcgtctaatcgacggtagctgtgccgaacttgccaatggaaccccgcaagagaagctccaatctaacaagcgtctcgcacgcaaaacagaagctctccccaacattccagtgttatcgtgagccaggtaaaagtatgtagcctcttaacaacggtggaagtcccaggatgcgccgagacccaagaactgatattttgtggctgatcaaagccaccaatcttccagcctcgctcggtagcttatgaacgagctcaatacaccatccccacataaccaacagctctcatttcatttcttcttgtcgatattcgtctcctgactctcgttctattgactcttaaaccccttttactcgttggccatgggcctcgtagtaggagccagtagatactccgcggcgctttaaaatttccatctaaaatgacagtttgtcaaacctttctgttattcattaaaactacagacattcggaagactcaaacttcatagggcttagagcggagagctcagcgtagacactgtttagtaactccagcaaacatctttgaggcatagatacggcagcttgtttgatttttccataaaaatggtgatatttgttcacgttttaccgaaaacctcgtagagaaaagtatcagggatatggtcggggtgtgcccaaactatacaggtttaaggtctagtcgggatctcaaggtctctttcatttagtcttagcggaatataatagtttcataaggttttctaccagctctatttccatgcacaacatgcgaagttcgacaaaatacaatgctgcagacaatgcatggcctgctcaaacaagcgggtttacggagcaacgaacctcgttaagcgacttgtttgagctcaactctgcattgccaacctaactaagcaaaactatttagtttgtattgttatccctacgatagagatattttttattcaaaccatcaactctgaagcacgaagttacagttgaagcaagcacagagcatcctaccaagcttcgtgggcgcttaggtaccctagacccgttgcaaacgctgatatgcatcaacacgcctcgcctcgccgaactgtcacagctaaatatgaaaatagtcgtatcatgttgacatttttatggtttatatgttcattgcataactcaaaccacgatgggaaaaggtaaatacaatcatgccactacacatacgacgtcttgacacgtacacaaagtgttaatgatcaagtagaaactgatcttgttggtgcgcataatctcagaatacatattttaagacgaccgatatcacagtagtaacctcctacctaagaaaaaaaccccatgtttccaccgtgtttttgtttgtcttcattctacaatcttactacccttgctttcagatcatattatcttggagtgctcggctttaggccctcaaccctcagataaacgaatcagatacccggccaggtaaagaaggtgaaatgataactgaggggcggtcacctctctcgttttgggagccacttttagaaacgtggttctggtctcgtgaagatccgagagacaagctcctcggtcaccgaagcaacttcttcttggcttgctacctaaaatttagtgatgaattttctgtacagaggctcatacgccttggcagtgcagtcacggagatgagacatgctataagggagcttggccgtgatggtacatatcttgctgggacgtggaaggatacactcccttcgatgcaggcaggaagcaggccaactgagtgcctgcccagccctggaactaggcttcaaacaatggggtcatcggcttccctgacatattggagaggaatttgataaccgaatgctttataaacttattagtggcacttgctcggtagatggcaaaggaatgattattagtaggtatcctattctcaagggaaagccctcttgttgtaagagtttcctatgatactaaatggccccttagcggcgttataaggggatttccagagcatggttgatccaaataccgggacttatctagtagaggctcctgattctgtgcacaggtaccgttggaatattctttgatacatagaaaaataggggaggggtctgtgttctttctgccgattgagaaaaagaagagaagggacagcctgtgagtgaaaaaaataatatgttgattaaaggctcattttccttccttcactagtatattagaaacgagactgatacctagctaacgaaacttcgtgctggccttgctgcaatttctttgcgtgataaagaaggagagctcatcacacaggccggcgtagagtcatgggaatcagggaatgatgttactggcactatttatcactctttccagcgagtccgcacttgtgacgagacgagctggggaagaattgctatgatatatatatttggcccggaacggcgattgatctaggtctcttctatgatacaaaaaactttacaaaattggtatcctatctaaaataaaacatcgctcttgtttggaaatgaacatgttggaattgagaagaagaaaaaagaaacagtcaaatttaagactttgctcgccctgaaaatcgctcgacatctccagggctaggacaaatatgagtccacatctcttccgtgtgcgcacttaagtcttggagacctttgatgaactcagcttcactcgactcctcctgacggagtatcctgcgcttgagaactcgacaccatgcccggagcctcacccagaactcattctgaattcgtagcctcatagctacccacttgtgttcaggggcatgatctggcagcaatacctcttctggttccgacggagggtcttccgagatgaggagcttctcgtcattaggccaggcggtatgctctgtctgctcggagggaagcacgattttgagaaattcaagtgatggcgagacgcaaagaaatagagcccggatcgggttgaccattgtctttgtgaaaagggacatccagtgagggtagaggatagcaaaatcagacattgtcagatgcgttgagccaacaatagtcatcatccagcagagggcccctgatccacgagtttcattacagatgtccacaactcgctcaaagttcgctttccaatgcatgaatgcctcggatgaaatggatagcaaaggctttttgaccgtattgtccggcgtttctcctcccggcggggtcccttggccccaaatatcaagcactatgccttgtccaacccatgacagtgagtcatcccggagtacttgaacggttgttgcgcccccaaatgaatggcccatgactgtgacattctcgaggaacatccggtctttccaggtgtcccactgaacgccagtaagtcctatcgaactcgatccgatatttcccttcttccgaaggttcatggctgcgactgtgtctccttgccctccatttatcatccccagaacgtggaacgcctccttgatctcctcaaggcggagttggatctgggctgatcgcagcttccggtccaccccacgggggttgtgaggtgctgtgtcctgagcattgtctttaggcaagatgtagtcgacaacataatatgggttcaactccttcttccttcgcctccgaacatgcttgcgctccccaccgggtgatgtgtcgtcgctgtggttgtaaagaacggctgtcgaggattctatctcgttggcctcgatatcacccggcaagctgacatacgtgcgcgcgccacttccatctcggtgttccacagctacaacaacaaaacccaaactagcaagctctccgcagattgagctataacataatcttgagcctcccagcccatgcgagaaaatgatgacgggaaacgtgggcttgtcggtgtctggcttattggtgtctggcttgtcggtgtcttttgcatcttctccctgcttggagtcttcgctggtcctcttgtggtcgggccaatagtctgcaaccttggcatttcgaaaggcgggcagtttggtgaagagagaagtagaggcaagataaccagctactggcagccaaggcaaattcatccatttagcataccccttggccgtagcgatccgtggccggggcatccaattcactcggtggagggtatttcgaccatctggcgtcttgaggtccttacgcagctcggaaggatagtagatgcccatcaggacagtgtccagacgaataacaggctttccgtgccgtttcagttcagagacaggccgagggttccgggctgggacttcaatatccatgtaaccaacattgtagggtccagtatatgtcggaagccggtgtgtgaatctgtcccgtagtgtcttgggcggtactacaggtggtttgggtggtagttcaacctcggaaggaatctccattgtcactgtggtattcaagaacaagactcgtatgacacaacatgaggaaaatttgaggaggatacggacaataaatcaataccgggtttacacctaatatattacgatacatcttgacatctccgatcgatctgaccgttggtgaatgcgggtcgcgtgctcaacttttgcaggaaaatgcgttagcgtctatgacgtagttgacgttgacgtatttcatgtgaagagagcatcggcagctcggctcaaaggcctgtccgaaaggcgcgagaacgtgaaacaaaaacatgaagtcgtttgaaaacaagtagcatctcccaattgcacattgaagtcgtctgacgagagaacgatttttgcctgactaaacttcttgccggttcagaataatggcaggcatgaatctagtggcgcaccttctctgttatgtggctgactaaaggcaggaatgcctggcgcaactggtgagggacgattggctgggagtaacgaaatggcttgaagaaagtgaacagttcgccgatgcctcactatgagtcaagcttattgccacacagcaatataagtatccgtcttccccccattgacatcggttggttaatcaacgtaattcgctttggacagcggcaatatccaaacaatcctgagaagcaacgccaacgtcaaccagggatagcattacataagcgtccggtgagtgactcaatcggcgtgtggcggcgaaaagatttcccgagtggacaagggcaaatttagtgtccccgctcacgtgaatcgatctcccacacacaaccatagcgaaactaccaaaattcctgacaatccacgttgtagactcaccatccacatcaacagtacaacaaatccatcaaaatgggcaaagttcacggatctctcgctcgtgccggtatgttgaatcagccaatccttactcgtagaaacacattgctaactatttctgcaggaaaggtcaagtctcagacccccaaggtacgaccgcacaacccacgataaacttccacgattctcgacgcccgaacagcaactgacaagattttctcccatcacaggtcgaggcccaggagaagcagaagacccccaagggtcgtgctctcaagcgcctcaagtacacccgccgtttcgtcaacgttaccctgactggcggaaagagacgagtgagcccgcctgacccggccatagacccgtcgccaaccaaaattctaaccaaactctctgcagatgaaccccaaccccggcacttaagcaaatcatccccgaccaaggaaagatatggagggctatccaggttgccatcgttaggcgcgacgctgccaggactgcattgtgaatttagtagcagtaagggtggaataggtcaggcccaatgcgccagccgagcaccctctctgatgagaaggaagtgcgaagaagcggcggtggccctactcggcgtcaggtgtcgttcatcaataaactcaaccattcgtcggcgactttctctcgttggaatttgcacgcaactgctttgtgaagttttgtccgccagaattcttcctgaatgtatacgctacatattcttgcgatcattctactgtaaaaatgcccataattgtccataaattaccacgtacttgaacgcgtagactcgatatctcgaaacacggccaagttccatcagccagccaacttcgcccgcccaactttggcccattcacgtgacctccacccactgtgcgaccgagactcaggtcgagctctcatccaagcactcttggatgacaagcaaccatcccgctccaaattcgctacttctttactcaggccatcccacaagcgcacgcagctatggcggacgtagaaatggaagataccggcgcaggctcaccgcccgccgcccgcaacgagtccgaaatgcagacccataccaaggccacggccgtccgctccattgaaggctggatcatcgtcgtcaccaacgtccacgaagaggccgacgaggagagcctgcaagacaagttcggagagtttggcgagatcaagaacatgcacctcaacctggaccgccgaagcggttacgtcaaggtaaggcatcccactcacccctccatcccccctcaaagcctgggatgttcgatttgcgcagaagcttactagaactgggatacttagggctacgctctgatagaatacgcgaccctcgaggaggcgcgcgcggccatcgacaacgctcacgagaccaagctgctggaccagaccgtaaaggttgacttcgcgttcgtgcgccctccgcccggacagggcaagggaaacagggccagccgggcacggagaaggagtcgcagcagaagccccgaggctaaggagcgtgaggagcgtgaggaccgtgaggagcgtgaagaatgaacgagagaaccttggaatccccccaaaaaagacgatttacaaactcgatgtcaacaaagaaaagtaaaagggttgatcaggctgggtggactaaaaagaagagagaccaaagcgccgacgtgctgtacctaagggctgtgtcatgtcggcacataatattatactctacgaggttagtagaccattgcactacatcaacttaggcagcatattctaatgttgggcagaatgatcaaagaagtcaaatatgctgaatcctcagatattgtgtgatgaagcgcaaggctacctctagtcactaatggatgcttgcccgtttttactagagcgtgcttgcttgctaggtgagtatgtctcggtcatagcaacggtcgatgtaattgcaatggccatgctgcccaacttctttctgttgttatatcagttcctgttgtcccaatcaccccaggcgtacacagatactaccctccaagatctcgcgagcaacatcgaactcttctcgtctgaaaacgaggccaggcggcagaaattttcgataagccccagcaggcttctgttgttatcagccctcgagtcctttgacccctgtaacccctccagatacatgaggtcacgcggtatagcactaaccacaatattgatccaatattctccctgtagcggagagcgataagtggaacgttaccgacagctgcgtggaaatggttactctcgactgtcagggttcgcttagagaagaggtttatcatgctttccctcttggctcaagatcagaggagcaagttaagccgaactatcgagataccccggaagcgagtatcaacatacactctccaaacttaagtatggatgctacaatggatgctacaaccccggattttataaccctgcttcaaagttttacccattgcagtgcctccttggtatgcacaaagaggccgtggccatttaaatagtctacggacaagccatcgtaggcgtgtgtctgatctccgtctacctatcgaactctggctatagacatcacctggcatttgaatcgttgagattcgtcccgaagaaatgtctatcatgaacccgggggggctatagattaagacaaggtctcttgcagatcttcgggaactagatgggattgtttgcctcgaaccgtattgatataccaacctcggtggaatgattgcagttcttgcatatatctctcaccaaacggactttggccagtcgggattcagtgttccaacgtgggatcagacatgtagtatccggggaagaccggccctcttgaccgtagctcatggatctatccggacttaaaggagcagggaagtgagcccgatcacctgcaactcacctcgtacttgatgcctgatactcactctaataatacctcccgcgtaaatacattgctgtcttttaccccgaccattcacttattcacttcggttagctagccaccatgtctagtagcggcatcccaccacgcccgtcacgctccctcgtcggcaaagtcgccatcgtgactggcgccgggtgcgctgacggtggactaggcagcgggcgcgccatcgccatcctcctcgcggaagacggcgcctcggtcgtctgcgtcgacctcgacctcgcactcgccgagaagacggcgtcgctagtcagcgaggagcacgcccagaagcagcacggcggccgcgggctcgccatgcaggcagacgtctccagcctggaggactgcagggccgtcgtgcagaggaccaaggcggagctgggcaggctggacattctggtcaacaacgtgggcatcctgggaccccggggcaccgcggtgagtaccgagctggcagactgggccaaggggctggagatcaatgtaacgagcatgatgctcatggccaagttcgcggtgccggcgatgctggagaacgagcgcggggatggtggcatccgcggtagcatcgtcaacgtggggtcgacggctgggctgctgggtggtgcgaacggcctgctgtatacgaccagcaagggtgccgtggtgcaaatgacccgggccatggcggtcgatcacggccaagatggcatccgggtcaacactgtctgtccgggtacgtaatgcgtcatgtgcggatcaagatgtggtagagagggtagcttctcccccgcagggcgggaggctgccaacgcaaccatgtttgatgatgatgataggctgacggttgcaatctatgaatcatactgcaggaacgatatacacgcccatggtatactcaaaaggaatgacggatgaacgtcgagaggcccgacgcgagagaacccttctcaagaccgagggcaacgcgtgggacagcgccgcagcagtgaggttcctcgtgggaggcgatgcgcgctggatcacggggacggtgctgacggttgatgctggtagcatatgttacagtgagttttgaatggacagggccgaagccgaagctggaagtggctgcttcggctggctgcacgacgggccacagaaaggcaagatcggggctggaatggatggtgagtgaaacatgcgggcggttacgtttgggagagaaaaacttggaagtagcacagaaacgaacgatacgatatgaactccccacagtttggcttggtggttgtgtgttgcgcagagagccaagtccaagtgaggggctgaggggaccttgtgttaccatatagatttagctctgcagttaatattggactggggatacaaaacacatgcatatggtagcgtgatcaattgataatggagagttgtcattggctgttgtaggtactacttgggtcgttggtcatgctggtgagttcgtttgtctggcggtgaccatggataggtaagaagcctatcggcacatcgccaagtgcagatacgaaccaaggccaaccaccaagaccaaatgctacattctctgagtcgagttggagatggctggatcactagcgttgtaaccttcagaaggctggcgggttacagtggggctgagagactcttccagctgctgccaatgacatgcaatgacatgtgctgcagctcccttgattgattcattgcatgcatgcattcattgcgtgtcatgctgtgtgtatgtattcggccgtggtctgagcactcgcaatgctcagcggctcgcacggaactgctcttcggccatctcgatggccgccggcgatggcaaaggtcaacagccgaagaccccttgaaggatcttgacggcggcagccagagtgccagtgccgtgagcgctggagtagccccaatcagcagatgtggcaaagcacatcaggccagtgggatagcaaaaacctgtctgagaagtgccccctggtttcaagtcaagcatgtcccaacaagcagatttgccttctgtaggggcagtactatgtaagcggcctaccgttgcgtgtagattgataggattcgggcggaaatcatgtcaatgcacatcaccatcgaatcggtccttgttggggcccgggacttccttagcgccctatgatataggctgacggaaggtagtgcttgcatgagcatctgctattcatatccagcccctgcaccgcgatgcgatgtgagagttgcatctcagggccgatgggaatcagaccaggccttattaatgattttctcccagggcctcgtcgactccctctgaactgcatctgaaacgcgcagtctgcagcgttgcaattcttctcgacttgttcgcagcagccatcctggtccaggttagccggggtggcgagccgtctgggacgattactgccacaaacgcagatagtcgcaggctaagggactgggacaagggctgtgtgttcagaaatagcaactgccagtgccgcaccgagcgcagatcctcatcatgtgccagcgcccggcctgtaatctcctggctgtgcctacaggatgtctcggtacgccctcgcagtcgttatccgatttgcggccggacggggcgtttgccttagcgtttcgtgtttggaattagggggccattcgttcactctgtgctgcccatctgacactgctgggctgagataacctttgctggttcgaccgtcacaaagcctcgtcgggcctcactttcagctgggcgcgtcaggtgcatgtacaggtactcgctggatgcctgcagatactaactagtattccaatatatgccatacaatatctatagcagcaggtttcctattcagccagtcaccgacctacctatgtaggcaaaacccagggcttggctcgcccagacaagacaagacgagacgagacgaagagccagcggacaagaaccaaccacgcgcgcgagcccactcgaatcctcctccctatcgcagcagcaagaaagtcgtccaagctctcgagctgttacatctgtccctgataccacgatccattggagtcccccccccggccgcccccctccatctgccactttgggacctggatatccctgccccagccaattgcccagctgcccgcttggtgcagagcaacggctgttacgtagcactaaactacttgaacccagtccctgttcgcgctgttccccggttctccaaccaaattctcctggcgcgcgctcgccggcaggctctcccgtctcgggagtgatagacaccaaccaactaagcttatgtgcatacatatataaaagccctgccgtgtcccatcactgcctcattccccgatcagcttaatcacttggtactcccaccagtgttcttttggcccttttttcttatttggatactttgtttccattgtctctcctttctctgggtttcagctgactagtacttatatctcacctcacccttgtctttcatttacttgacagtaccatttgaaaccttttttcagcttacttgcttacaccacacacgtacatcatgatgctgcccaaaacagctcttgctgtcgccgctctggcgctcagccctgtgaatgccatctggcccatccccatcagctccaacctgggcaaggagactctcttccttgaccagaccgtcaaggtcacctacaatggccaggatgtaagtcacctacgcagatctacctttgcctccaagtgagacctaacacgagacttctagctcgcctacgccgttggctacactcaccccaagggaaccaagttcgactccaagtccatcgttcagggtggtcttgagcgtgccttcagcgccatcttccagaccggcctgaacccttggatgctccgcgagcgcggctccagcttcgagccccaggccggcaacggctcctacatcaagaccctggagatcaggcagaccggcaacgacacccagaaggtctggaacggtgttgccggctccgtcgatgagtcctacaagctgtccctcgacggcgacaaggccagcatctccgccgtctccgccatcggtatcctccacgccctcgagaccttccagcagctgttctacaagcactccgacggccagcactactacaccgcgtccgcccccgtcgagatcgaggatgcccccaagtacccccaccgcggtatcctcctcgacgtctcccgccactggttcaccatcaaggacatcaagcgcaccatcgacggcctcgccatgaacaagatgaaccgcctccacctccacatcaccgacacccagtcctggcccgtcgagattcccgccctccccgagctcaccaacaagggcgcctactccaagggcctgacctacagccccgacgagctcgccgacctccacgagtacgccgtccaccgcggcgtccagatcatcaccgagatcgacatgcccggccacgtcggcatcgagcaggcctacccgggtctctccgtcgccttcaacgagaagccctacacctggtactgcgcccagcccccctgcggctccctgaagctcaacgacaccaaggttgaggagttcctcgacaccctcttcgacgacctcctgccccgcatcaacccctactcggcctacttccacaccggcggcgacgagtacaaggccaacaactccctcatcgacccggccctcaagaccaacgacctcaccgtcctccagcccctcctccagcgcttcatcgaccacgcccacaagaaggtcgccgagcacaacctcgtgccctttgtctgggaggagatgcctctcgagtggaacatcaccctgagcaaggacaccgtcgtccagtcctggctcggcaacggcgccgtcggccagatcgccgccaagggccagaaggtcattgactccaactacaactactacgtaagtcctcatccactctattcatagcacaacatcagctaaccagcgtcatagtacctcgactgcggccgcggccagtggctcgacttcgacacccccgtctggtcgacctactaccccttcaacgactggtgcaaccccatcaagaactggcgcctcatctactcgtacgagccccgcgacggcgtccccgacgagtacaaggacaacgtcctcggcggcgagatggccgtctggaccgagaccatcgaccccgtctccctcgacaccatcgtctggccccgcgcgggagtcgccgctgaggtctggtggtctggccgcaccgacgcccagggcaacaaccgcacccagtacgacgcccgcccccgcctcagcgagcagcgcgagcgcatgctcacccgcggcgtgcgcggcacgcccatcacccagcagtggtgcgacatgaacgttgttggcgactgcggccagccctcgtaaagagcgagcgtgcgttgaaagaggagtagtagtggagaaggatatgagagttgggaaggggtgagagaaaatgatggtttagaaccaacaaagtcgctgatggacgcgggattttggctacgacgggttcgctggtcttccccgagagatgtaacagtaaatatttggaaaagatttgggaaagagcggaggaagtgtatcatgtacagattgcggataatctcggatgggctgtgatatctgtccgcctctacctagctagctaaacgaaatgagaaacgtctgtcaattgacccaaagaaaaaaaaccaagctgtcctgcctgcgttggatcctgggtgacttgctaccaatgaagtgtgtgattgtatctccttgagtgcgcaatgtctagtgtgtctgtcacccttaacccactctaccattgtagataagtacttggacatactagaggagcacatacataagcagcaagaatattttagtatacaagtcatttaccagtaaaggctttagtagtttccatgtaaaatctctatagcctacgattgatcttattttgcctgaacctagaactaaaaggctgcagcgaaggaggtgactatagggtaatataggtttaagtagcaatttgtgacaagccctattctgagcacatccgctaagttacatgtactcttgataagctgcccttgcttcaatttccacaaagcaatgagcagttgaggagatgcctgtagggtaaattgcgcgtgttgggtcaagcctgttggaggctcgtgttagttggatttttgtggctggtggtgatgcgttggttgaatgatggcggtgagtgtggctggtggttggttttctggagccctttggcatgattctgctggaagagggtgaatgttggtgggcgatgacaattgggggctgaaacgggaagaatacggagtgttggtggacagaattcatttacagcacaaagagtcacaggctgaaaggggaaagatgaggaggtactactagacaaactggagacaaataaattaaattaattggtgcttgagcagggccgcacacactgccaacaacaacatccagttgggctgactggcccatctgaaacggtgctgatgcaagcagcgacggaggagaaagagtggatgattgagggtgagcgccctgcatgattggaggtggcctgtgggcgaccggttggtcgggtcacgctgggtcactgacaggcatgactgtatttccatttgttcgatggacggtgtaagcaacacagtctctcccacaattgccagtccttgtctagaggttccgtcaaggctgagtctgcgggcgggtgtgactgcttctggacggcctcacaaggcgtgcttgtgctctgtctgtgtcttttgagtgtacaggcagactctgacccactgccgctgtttgtctgctggtcacagccagaggcctaacgctggagtgagtgagccttgggaattgctcgtctagcctgagtagagtataaatccccccgttttctctctcccttgcgcatgagtcaccacagtgaggctacaattatcgagagcagaactgcagaacccagtgtcccattaaccaatcgatcacaaaaccccatttccatcagcagccaaggaaacccgacgctcagatacagacagcatgtccagcaccccgtcagcacagcaggttcaggttggcacctctgccctcatcttcaatgcaacgaacccagacgagttcctcattgggtggcgcataagtaaaagccatggcacaagtaagacagcacctcattttatgaacatctttcccttcccacccagcctattttcccgatgattgtctaaggaggtctttatgctgtttatgaatgcccgccttcgctgatgaaactcccccttctatcggcaagaaattagagtacacgctgacctggaaatcacatcagattcatggcaattgccaggcggccacttagatctagaagaggaggtcaaggactgcgccgtcagagaggccaatgaggagacaggcctcaacgtcaaggccctcggagagattgaatggacaaacgacatctttaagaacgaggacccagttaagcactacatcacgcaccatatcgcctgtgagatgttggaggcggatgcggtgccgcgggtcacagagcctgataagtgcgcagaatggaggtgggagacccgggaaggactcgagaagcgccagaagaagggcgagaaactctttctgcctctagaaaacctgctgaagaaaacggctggaaccgacaaactaagaaatccgaaagtgagttcggaggaagcgcgaggaagggaacaataggagaagctctttttcttttttctttttctttggccgcccctgaaaggcagcagtcacgagagcgagaaacaggagaggttgttagagggatagagagacacggatgcaaaatccaaaattacatccttgttgtttacgttgtggcagcgcattttgtctgggagttggtctcattctgaaatgatcgccatctcctacttgtcgtttgtgtcccgggggctgggagctagatgcagggaacctgcataagattaccgtatccatatgcctatcgtaattatgagaagcagaattttggaaccacgaggctcgagcgtgcatgtgccgaaagaagtcagtctcagttggctcaccatctccactgatgtcgtattgtgacacggacagattcttgacgtattgtttgtttttctctcctgtactaaacttttagattttctcatcgcctctgaaaacgacaggttgaggcgacggggccaagaccaatgttgcaccatgttgggttgggtctgttctgtgaacgggcctttctcagccacctctgcctgcctatgcatgtcttggaaaagctctgtccaagtggagaagctgtctatccggatgaagccgtcgctgctgagctgaactaatcgccttggtgggaactgcagccatcacaggtctgatctcggggaaaagacaacctctttgcctatcatctccctcctgtctcaaccgatctgccagcggggggccgcacagccaaagaaaataggaacaggaataggcagaggtaggtctgagacggaggcccccctcccgcccctccaggaagccgtgtcgtttgatagagaggggcttgcttgcgcatgaaccgcgccgtctatgcttagcctggaggctcgagcgatcccttggcgggggatctgacagatggcgttctctaaccaagagaagggatggctgttaagccaatcgacttcggatcgcggcacggaaaagtaaaaatagagattggcttgcatacgcttgaggttgtttgtttgtcgtagaggctaatcttatgccgacctgatggccataggttcccatatgccaaacttggatgatattgaagccgcttcgcaataaacatacaccgctggcagtctgatgagtgactactcttgtggccaagagcgctatgccgtccaattacgtacttgccgatatgaaaatggcgcctcaccttctgatgcagctggggaccaggactttccgctaggtgccgtgttctaccttcgtgagacaaccatccgccgctactcatcaccaaataggatatctgattcgctttctcacagtcacctgtggcccattggtcccgcctcgtgatgtcgccacagtcaaatctcccaacctctataccgcctggtcgaactgcgacatcctcagcttgccggccacgacaggctcgagtctaggtcaccgatccctgctgggatctcatctcagaggtctcagagcatcacgccggtcgaggcaggacggcgatggcatctcgagcgagatcagattcccttcaggtataagaagggatgagatcgctgtccaaatctttcccttctcatcatcacaacaacaccttccttcatctagtcaatcattcattccttctttagtatatcctgctcacaactgtctaatactttgagttttctgcacatttttgcattaatttcttgtctttgattcggctcaatcttgttcataatggccagtctcgtcactcaactgcaagtccttgctcaggagagcggatgcttccttgacatctccgccctcatcgacctgagcatctgccccaacatcaatgtcaaagccgacaggcccaagatcgtgaacgtcaaggaagacggccacatctgcatcacacccaccgaagtgagtagaaagcatccggatggctaaccatgaacccatcggctaacttgatcagggggggaacaacggaaacaatggtggcaaccccaaccctggaaacaatggaggcaaccccaacccgggcaacaacggcaacaacggtggtaacaatggcaaccccaaccctggaaacaacggcggtaacaacggaggcaacaacggcaacggaagccagcctaagcccgaccccaaccagaacggcaacaccaacaaccccaacccgggaaacaacggtgggaacaacggcggcaaccccaaccccggtgacaacggcaacggcggtaaccccaacccgggcaacaatggcggtaacaacgggggcaacaacgacaatcccaacccgggaaacaatggtggtaacaacggtggcaatcccaaccccggtgacaacggcaacaatggcggcaacaacgggggcaacaacggcaaccccaacccagggaacaacggcaacaatggcggaaacaacggaaatcccaacccagggaacaacggtggcaacaacggaggtaaccccaaccccggtgacaacggcaatggcggtaaccccaaccctggaaacaacggcggtaacaatggaggcaataacggcaaccctaaccccggtgataacggcaacaatggtggtaacaacgggaaccccaacccgggaaacaatggtggtaacaacggcggcaatcccaaccccggtgacaacggcaacggcggtaatcccaacccgggcaacaatggcggtaacaacggaggtaaccccaaccccggtgacaacggcaacggcggtaatcccaacccgggcaacaatggcggtaacaacggaggcaaccccaaccccggtgacaacggcaacggcggtaaccccaacccgggcaacaacggcggtaacaatggaggtaacaatggaaaccccaaccctgggaacaacggtggtaacaacggcggcaatcccaacccgggcaacaatggcggcaatcccaacccaggtgacaataagcccgatcccaatcagggcagcaacaatggcaaccccaaccccggtaacaacgaaggcaaccccaaccccggtaacaacggaggcaaccccaaccctggccagtgccccacgaacacatgcttcgaagtccccgatgaggtctgcgagaagcccctcgttgccctcgatctcgacatcctcgttctccttgatctcctcactgaggaggaacttgagaagtacctcaagatcactggtgctatgccaaaggatgacaaactcgaagttgacaagaagcctgtcggcgtggatcctctgctcagcttgggacttctcaatgaagatgaaatccttggcctgaacctcggcggcgagaatggcctgctcaaccttggtctcggaggcaagaacggccttgccaagctcagcctgggcaaggatggtagcatccttgatctgaacctccgcaagcgccatgaccacgatgatcactacgatggcctccttgacattgacgtcggtggacagaaagacgacaagaacgccgccattgatattgatgtccttactcacgatcgtcgccacgatgaatatgatggcctccttgatatcgatgtcggtggacagaaggacgacaagaacgcggctattgatattgatgtccttactcacgatcgtcgccatgatgaatatgatggcctccttgacgttgatgttggtggtcaaaaagacgacaagaacgctgcgattgatattgatgtcctcactcacgatcgtcgtcgcaactgtggatctacctgccacggcggacaggactggcctcaaagcactcaacctaccaacccatcgacgaacccatccacccatccttcaacctatccttcaaccaacccttcaaccaacccttccagcaacccttcaaggaacccatcattgatcgacattgacgttctcggcacgaaggataaggaacaggccaccatcgatatcgatgttcttactcacgagcgccgtagcaaactctccgcccgccagcaccccaagcacttgctcgattcccagggtctgctcggcatcaccgttggtggcaagaaggatgaggagcaggacttgattgacatcgatgttgctactcacgaccgccgtgacggtggtgacaagggacttctggacgtcgacgttggtggctacaaggacgagcagcagtctaccattgatattgacatcctgaccaagaaccgcccctccaaggaccagcctacccccggtggaaacagcggcaacctcgaccactacgagcccatctgcaagaaggccatcaaggaccgtgcctctgccgtcagggtcaaggccaaggacgtcaaccactgcctgtccctctgctctgccaccgctgctcgcgccaccattgccgccaaccccggggccatcagcgctgctaacatcaaggtctgtgccgccattgacttcaactcctccgctgtggatggcaacaactgcgctttccttgtccgcggcaaggacgagtctttcgccgacactgagctcgttgacaacgacaagcacgttgtcttcatccgcaagtaaggccatcttaccttgctaatgaaatgggagtcacttgacccttgtcgctctggcctagcccggcgatacgcatcacggggattggaggtatatactgggagatgtgtagatgacacgtgaagcatgaacgcattcttttctctgtccttacttcatagctgaaggcggttctttttctttcccttcgttttcacccttattcgattgactcaaacgcttgatacgaagccgttttgacatttttgtactttcgctcgttgttaataaagaattcgttcgtttttaatattgtgcaatacctgctcgtgattagtgactgtcttcaaaacctaccatttatttcgttatgtggaaatcaatactccattattaactgctggtcagcataacatagacaatatcctgcaacgctgatatgccttcaacttgcgaccacttagcaatgcaaatcaagcagccgtgaactcatcaaagaatgatagaagctgcttgagacttggttactataaagtagcaaagtaaaccaatagcaaagcttctttcccgtattaggggcctaatgttctgaggactggtcactgaagccagggtacagaaccctctggtaaggcttgatgagcgactcgtgcatgcaacaagtgtgtatcagtaccgggaggaatctaggcagcagcaataaacgcaggtgaattgatcgagctggaccggtattcttactcaacacaatagtagttctcatcgctttcaataacctcctagttgaatgagtaggggcacgttccagtgctgtcaacagaattcggttcatggtggctagtctcgatagagacatacccgcttatatgcatatctctcctgccaggtcaaggacatcaccaaatcgtatcgcagtagccgagcatcgagcttgaaatgacgacaaaacatgctggtagactcactgatactacgtcccgcgcgaacccgcattgcatctgcacatgcagcagctcaccacgccaatgctgtgacaccaagtagccccatgatgccctcgacatgtctaccctgtccgaacctcgccggccacgcctcctgccccagaaccgcaagctccgacacctgaagggtctgtcgctgcgcaacctctgcttcgctcccgcgcatcgccaaaccaccgacgatgccgtcatcggccgcagcccgcaccgcgcgaagctcgaggccctccacgaagccgggtccctggttcactcgcggtcctcagagcaccttaggccggacgcgctgaggtcctcttcgtccgatgttctgaggccgcccaacgctcgtaggaccagcttaagcctcggctcgacgcagctgaacctgcaatccagacagaagaaactcgaggagctcgtggaagctgcggttggcgatgtcttcttcacgctgcatgtgacggatgtcgaggacccggtgtacatcagcgaagtgtgcgagaggtcggcggtatggcgcgcaatctcccaccgtatgcgtttctgtttggatgggctctgacgattttgactagaacttcgacttccaattcttcgatttgtcgaaccgccaaccatccatatcccgcacccaccggctcacgatccggctctgggcaaagcgccctaaggatgcgtggagcttcctgctggaggagattattgacttgcggcagctcaacttcatcggaaccctcctcgatagacgataccctccaaatgcattggtcttccaccttgaagatggtgtgtactcgttcgactttccgaacaagatatccgaccctaaacagatcccgcccatcccgacctcgtcgtacaatgcgctgatgaagctcgccaacctggaaagctcaattgaggacgcgatcgagacacagaagcacatcatgcaccagatcaataacatcctgcaagaggacccccctgattcatctgacatggcgcaagaggacgtaaaagtcgcaaacgcctatgtctcagcccagcaacgggccaatgccatcgctcggcgcaagcgagacgagcttagagagtcgctcgccaaccgccgagtggcaattgcaaacggaagagagcagcaggccgaggcggaggaggacattgccaacaaccgccagcagctggaggcgtccaagcagctcgtcgagcagaccgagcggcagatccatgggcagcggcgccgtatctgctccgagctgtcagagatattccccatcacacccatccccaacgcgccgcccctgtccttccagatctgcaatatacctctgccgaattcagtctacgacgcgacgatagtccgtaccattagcgaagatacgctatccgccggtcttggcctcgttaccctcctcacaaaacatctccaattctatctgtcacatcacatcccctaccctctctacccatatgggtcccgctcctccactcgcgacgacatatcccatctccccgattcaaagtccaccacccgcgatttcccactctaccttccccgtggcggttctacaaccggccagtggcgcttcgaatatgcctggtttctcctcaacaaggacatcgaagcgctctgcgcttctcagggccttaaagtggtggatatccgccactccctccccaacctaaaataccttttatacgtttgcagcgccggctccgaggacgtccctgagcgcaagaagggcggcgtaaggggcctgtggctcggccggctcatgagcagaaactcccttgcgcccccgtccgtcgatggcgagagcagccggaggggaagcacagacagccaagctaccctccatccccacggcgacgtgctgcatagccccgtcaaggagaacggggccagcgtggaggggctctcgctcccgttcgcggaaggcgacgtcaacttcacgctgcggacaaaggggctgagggagaatgtagcgtggaaataacgcggttccaactcaaaatcaggatccggaatcaaatcttgatcactagcatgtagttctgtcatatgagcgcggagggttgtgaattagcgtaattatctctagcatagcagagcgtctgatttaatacaatatatccaaacccacatgcagtgaaccctttccaagcccaaagacgagtattgtacaccactgcccgagaaaaggactacgtgaaagtcattagaaaaagagcagcccgtgaatgccactccagaaaaacgcccccaaaaaaaaccaaaaaggggtaaaaatcgttgaaaaaaaaagagactcctatcctcatacttcatcgatctgtccccgcaaacttgacgctcttcctccgttccctctccccaatcatcctccccggactcgagctgaggatcccgccgccgctaccggccgagcccttgctcagcgcctcccgggccatccccacagccttgctctgcggcacgtcgtcgcggtcgctcctcaccacacccgtgccacggggctgggggctcgatgtcctcgaccgggagcgctccaccgccacgcgggcgagctcgtccgcgcgcgcggtggccatctcgccgcgatactttccgggcagacaggcgtggccgcatccgtccatggggcaacatcccccactgtacttagcagtggggtcggagggcatgacggagtgccaggtctggatgcacgatgcgtgaccgccgtgggcgcacccaggacagtagaaccactcggagagggagagcatctcggggtgcgcggctgcctcctcgatggggtcgtgggcggcgagctcaggctcgcgatggccacagacggcgcagggggccatgacggacttgcatctctcgcaggtccagacactggcggagctgtcgagggggtcaatctcgcgcgggcggccgcatgaggagcacgcgaggctaaccttgacggagtcctggccgggggcgaagattgccgtgtagcttttgccccagtatgggagaccctcgggccatccctgaatgcagaggtttcgaagcaaagcggcctcgacgaagagacccatccccatcaagcgagagtggtgctggcgcagtatagctctagcatggggggtctcgatgatggagtccgggacaaggggcttgagaagaagtacgatggccgaagcgttaagagcggtcgacttggattcgaaatcgagggctcgggtgatgagagcatacgggtccaaagcaggcactgaggacgacggctttgaggtagatgcaagcaggggatgaggatatggtggatcgtcgtcccaggggatgtagtcgctttcaagaatatgtgatcgagggtcgtactggtagtcccaagacggcctcctcgaaagagctgggtgtcgagcttcaggtcttggcgagggaaatttgatgtcaccatccaccgactgactataattctctgagtcctgagaggggaaagatgtctgcgatgggtacgtgtcatcatcagtcgcgactgtcgtctgagatatcataaagacttcctctggcgagtcagtcttgtattgctttcgtggctgacccttttcgggagaatcccgtcgcagatgatcgcctcggattcggctaccatactcaacgctgcttccatcgctagttttagttttcatagactctgagtgtgataaattggatttcgcaagcccaccggcgggccccgagcttcgtctggagagctggcctgtttcggatatcgaaaacagctgcccatagctctcatccgagttttgtctcgaaatcttggacgtcggcctggattgctcctttgcttttcgggcaatccagtcttggctcgtcttgggtgaagggacatcaattgcgtgcgctaaggcctccgtatcatagaaatcatacccctctgtgtgtgaaacctcgctttcttcgctggtcaaggatatggggacagaatccagacggcgtcgtggggtgctcgagtggcgcatgtattcttcatgtgcggctgggccaatcgtgaatgagtctggctcgacgatgggagtcaatcgctttccgtactggaaattttggccattgctgtccaccccttggtggtcgaccggccttgctattggtgtcgggacattggatgtgctctcgtgaatctcgtccgagaggagagagcggcccaacaagcggctatcagcaccaccattggtcacggctgatgggcgcctgggcgttgcgtcaccagacctccttccttttgacgccctatggacctctagcttcaacttctgaaactgcgagagtcggagttccagatggtactgtgcccggcgcttgagaagcagggacacggcaaaagcaagaactctccatgtctgcgcaagtctgaacagactggcagcctcggcagcttcagcatacctctccataatattggtcactctatcaaccatgggcttgccatcctccttgtaaggaagctctttctccagcgtctcaagatatatactggcgagatattggtaactcgaggctgttttggccgctggtagatggccagaggccatggcctgttgagacttgaaagtgcccgtagtcttgattgcctgctcgagtccgaggacaagtttcgtgtcctccatactcgacggcggcgtggtgctcagcgagttcgtggttctagctatcgaccgtctcttgcgcgctccccgccgtgggctgataaagcttcccagaacatcctcctcagagtcgcttcgactcacacttagcattggcatccgggggctcgagtcgaacgagctacgtggtatcacgtcggaagcattcagcactgatgaccgtcgaggcctgtgctgctgagcgcgctcgtccagaaacatgagaacatcccccttggaagaaaatgccatggcagaagtaggtcggcggtccaaggtccggggcgcatgtgcgacgtcacattggttgaataacccatcctgcccaactgtccagagcatatcctgatcctgccaggccagtgcggccggcgagctgtcgaagcgctcaatctctttgtagggcagcgtcggccgggcgaggtcccagatatgaaccacagacgtaccatatcgtcgtgtgctgttctcgtcataagtgactgcaacctgggctgctctccggctccgtgctgtagccgaccataatccgggtctccatgccacggcggacacaggggccggcgtggaaatcgtccatttcggcttctgccttcggtcggcggtactccccatgtcccacacgtgcagtttgcagtccgagccagaagtgattaggtgaatgccgtccgggtgccacgagatacccgtgcaagccttctcgtgggcgttgatcctcagtagcggccgtgacggcgacctcacatcccacttgatcaccacaccactatcagtgcagcaggccatctcatgaccaaccctcggcgaccacttgacctgcctgatagagtcgatacagcgtagagccgcaaaccgctggcggaaggtcaaaacaccagaccgcgtatggatcgcattggcggtatcaaagacccgcgcgaggccgtcctggctgcccgacagcagccagctgttcaagtgagggttcacatccagggtattgacctggcgcgagtcctcctgcatgtggatgtactcgagcggctccgaggagccgccggccccgatgcgcgccacatcgtaggcgaagatgcgcccgttggcgcacgccgtgaagatggtggagctcccgtgccacttgacgtcgcggatgttgagctggtcgggcgtcgcgttggccttgacgcccgtggcgggctgcgcggtgatggcggcgcgcaggtcgacgccgtcgccgaagcggaagccgaagttggtcgggtggtcctcgtggacgatggtcttgaggatgtgaggcccgccgagggcgacggcgcgccggtcgggcgagacgtcgaggcacgagatggggacgccggcgacgtagaccgagtcctgcgacttggaggggcggaaggtcgcggggatggaggagctgtgattaccgacgagggaggagtgctcgccggacgaggtgtcgggcgccgacttgccaagcagcttgcgcatgatcttggagtcgcggttatacattgtttccgggagacgacagggcccaggacgccatttggggcgagctcagatggccatggaccggatgctggggaagagtcttggtgatggtgggatggatatcgactgagctatggtagctacctagagtagaggctcccttggctggcctagtcgctacatatcgccagctggcccgctgtaggaggagcagcgggagcctggagcctggagctggaggcacccccaccaccaccacaataaccccagcacacccccacagatgcccaccaccagcatcattcagctttgtgctgcgcagtcacgtgtgtatgcgtgacaccactgctgctaatgctgccagcttcgtgatgcgaccctaggttttcgtgatcggctgctctttttgataatgattgccattctggtgactcactgtgcatggcagggacagccctatcgtctcaagtattttcatcactcgtgcacggcccaagaatgcagcctttcgtccaaaggcttgcaccgcgaaccgcccgtagttcatgcaggtccccaattccatacttgccctatgcatcatctgacgtcagaagaggtccctgaactctcacactgtctgggtcaaacctctcactatcctagacatcaaatcggccatccaagccccaacggtcgtctaagccagccacttgcgtgatcaacggttcatgtttcagtcatgttagtcaagccctggacccctgaatgcgcagaagactcaaaatgatatcaatttcttggtgtcgtctatattgacaaaataatacaattccgtacgcccatgctctataggggaggagcaaggaaggaaagaaaaataataatccaaaagggatgatccctagaataacgcctgtatgaaatgctatttcccgtccgcttaatgacttgccctatgcaagaattatctataatgcagtaaaaaacctctcgctctttcgaagcctatagctcatcgcgctggagactgggccattcgaatgaccaatcccgatcgggtacagggagtccgatccaaaatcggacgaacctattggtttcggaggagaagatatgaaagctgtagttattagttagcttcatttcaaggcaaggccagaagggaaaggcattctcaaagatgggcaagagaatggggggggataactcacaatgccgcaggcgctctgtaccagcttcctgtgatcagtgcgaccgcgtcccagaccaatccaaactcgtgcttgaattgttctgtgatggtctgaggccggaagggctcttccttctcttccttttccggagatgtggactcgctacccatagtcttctcctccttcatttcatcaggagtggctgccactgactccttaggttccggctcttttttactttcctcagattcaggttcaggctcctttttgcttttctcaggttctggctcctttttgctctcctcaggttcaggctcaggttctttcttagtctcttcagattcctgctctttcttactctcccgcaacatgtcgcggaatttggcgagcgcgttcagagaagagctaagccgagcatgggtgttgaacagtgcgacaagctcggtgcgcttcagcacggggaggtcctcggcgttgtcgaactcgaacaggaccttgagggccgtcccgtagcccgaggtctggatcttgccccagagccggcacttgtcgcagccaacacaatccataatacggctgacgttgcggaaccggttgcgaaaatcctccttcagtgacggcccctcgccgttaacaaacatgaggccctcgtcgaagatctgggggacggtggcggcgcggtcggtgacctcgaggaccttgttgcgggtcgcaatgtcttcaacctcgtcgccagtgcagaaggtgtagtccttgaggtaagggccaagcttggcaaccgcgcgtgtaagaagagcgtagttgaagtagaggttgctgatgcggtctgggaatgggtgaagacgggcgacgtagcatgacagattggggtgccattcgccggttgtctggttcaggaagtcccagcacagatgggtgctgatactggcgtgcattccggacacgacgcggtagaacacacgcttctctagacactcgtcgttggtctcaacatcgccactgggaacttcgagcttgtcgtttgacagctgtcgagcagccgcgtccaggacttgcttaaagtcctgctgcgcgaggttcttcggggacgaagagcccaggttggcggtgtgggggaaggagctgcgctggaagcagttctcgcggtagatggcatcccagacctgcctggatcccatgccaccgtagccggtgaatcgttctgggtttcggaggagactgacatagtcgcccttggagccggcgctctcgtcttcgggaacacagtaatctcgctcgtcgcattcatcgtcgtattcgaacacgcagccctcgctaacgcctccacccagctcgcccaggagaggcttctcagggtgcctcttcctggcgctctggcccaagtgctttgctctggggccttccagctttcccaactcggcggccctccagacctcggggatatcctcctcgttatcgagcgtctcgacggcgcatccaatgttggcgcacatgccaccctcatcgttccagaagggacacgccttgttgaagagattgagtcggtagtgggagaagaagtcggtggttcgggtcaggtcgtcgagggctggcttgacctgcgcattcaggcggtcgagagtagcgtaggacgcacatgcatcctggacaatggctttgggagaaatctgtagaaacaaagttagaagcgagcgcttctctgggtcctccggcgcgagctactgcttaccgcacaatcttcctgctcagagcatatggcagcaggcgcccaaagggcaaacagcgacaagtagaataaccggcttgccgacttcatggtgaatattggtgattggtttccaggttgaaaccgagaaatttcagcctggctgttggagggcaagatgtagcccacgtgtaagtaacgatgcggtggaggtacttccagaaatgcactataaataagctccaggtactgtctggtgcaggcgcaaagtgcacagacttggtcccctgtccgctcctgcagaacgtggtggtaaaacgaaggagaaggtctctagcaaacagagactcggggaacgaggaatgaagcgaatgaagttgcagttgtcctggacaggcccggccaatttttaacaaccgtgaaacaaagaagacacgctggcggattccccaacaccagatgtgacgggccagggcggacgacttcaattccatgatacccttttgggccaatgtggcctgatgtagctctacacctccgacccttggattggtaattggaatctctcctaagatacctagttggctacctaacaagtcagcaaaagccggccgggctaggtgcactgccgagcgagaaagattagaagtacctgtgtcctaacgaatggtcatgcgcatccgtacatggtaccacctacttcttccattctcgctccatgatcgcccagccccttgccgcctctttttgcggctggagcgcacatgctccattaggaatgtaaagatcgcgcgttcttgtgttccctacaccgtctatattgagcggtcctcttgtcatacctatgtcactggcttgaaccgcgctttgctaatacctacatcctccaaccatgggaggttactatgtatggcctgcttgtcatggcgcctaagtctacggatacagcgggttgacgctgtaagtggctgtcctcagtagaatgcatccctgttccgacggctccgtccgccaatgactcgtctccaggcagtttggccacgtttgtaccctctctgcctgctagccaagtacgtaattgaatgttagtcaaggccctaatacgatgcagtaggtgttaatagttgtctgtcttgtacctgggtggcggggcacttccgactgcgaactggctagtgtgggctcgttcaacggagaagaaaaaaaccagtagtggcggtttagttggggctttctgataaggaccgataagcttgactcgtgacggaaaagcatcgaactgcattcacatcggccatcacgcctgcattcacggatgggcagcagagccaagatcactagagggggggttattccagcaaactaaactttctcggtttatttagatgggtctagtcctcgtctaccaactccaaacaagatttccatgaaataaacccagcatccaactgcgatgcatggcacaacagtctgattagaaagcttgagagtcccagaaaagaaacacaaggcaaggctatggagggttctttcccggggagacgcaggcggtggaagaggagacaagagaagaagtaaacacatgagtggtaaaactgcaaaataagtaaaagcctgccagccttcccgtggttgcctgatgtgacaaaatcaatccttcacgcccacccccaactgtccagatcagtcaagtctaaaggggccacagaagtattttgtttccaatccaaccagtaggcagcttcgacagtatagtcgtgccggccaattatttcatcaaagcgtatcagaccgtaaaatcgtcaaggaaaggtagtgggaccgtcgcggcgtgagaagggatcgattggcgagttatgaaaacaagggaaaggccagaattttggctcactgagtggggggctggtagttgatagggcgcctggaagagagggggttacttgttagacttggagaatgatatcgcaaaagttgcatcaagaaggaaggcttacttgaagaggaggatgtgaggctccggctcatggacctcgtagtgttcccatcccaggctctgcacgttcagttagaaacaaatttacgagacaggttgcgacgcgcacatggcgcactcgtgagaccagttggtgggcgaacatacctgcgtgatgcccagtgctcgccactcttcctcccataacagctttagggttcccttgttctcgtcgtgatagtctttggggatgaccttgagcatagccttcgggagttgtacgtgtcggtattcaaagaaactatcgttgtatctgatcgaacattcgaaccatcagcttgttttccggtgtgaagagggaagagggataggcgagaaaaacatcacgaggggagaaagttggggcgtaaacaaagactcaccggttggagtagtggatcgagtcgatgaattcatccaagcgctttcgctccccgtcagataggggacgaggggacttgttccggcgggtcatgtcgatatccatagcggcggcaggtgtgctatgcgtgaggacaaggtcaattggtgtgcgccggagaagttgcgccttgggtggtgttgggtgaagctcttgttgttttggcagaaaacgggccgtgcagtttgaggcggggcaccaccaagaactgggccaggggaccactcgggcaagctacagccttgcccaaatacaggcgaggtacttagtggtgtaggggacctctgggggggggctttggggtgcaggcacagaagagtgcagaggcttggctgtgtgtgagacagcgatgcaaggggattaaatcaccagggcagagtgtttgtacggaaagtcccagaaggcacagattgcgaggagagcagaagtgaggagggagagggagagggagaaggaaagagcagagagggggcagaatggtgtttttgaggttctgcttgctagagcgcagcccagccgctgtccgcccagcccagcccacggcaaaaaggtgggaagagtggacaagggtgcccactgcctggcctgactttgcaggtaacaggctctgcttgtgcacacaatcactgctggccacgagatggcacttattgttttgctattctccgtcactattgtgtgagggaggcaggtaactaccaggctcgagaacaagcaactccccaacttcgtcttgtccttgattgtgcccatgctcccgccattcgtggaggggcagccggcaccctgtcgctgggttcgccttggcctctagacatggatattgcgtccagccaccgtcacgttttcttgtacaagagacgaatcactggtgcgaagcggagtgatagtcgccggtatcatgacctgttgcttatttgctttttcctgcctccgcccccccaacgaatagaaaagggctcaaaatcgaacgttaatctcgtccccgccgcctgctagtcctccaggagagacaagtacatacatgtctggccaggtactaatactagcagctggataagactatcacgagacctcctccggacaccgcatgtcaactcatgcagttctaaacggtcaacagggacaaccgtctttctctctccacagaccaacctcccgaattctcgaaagtcccctgcagcttcgattcgatcgcaacggttctaaagtggccccgagcttcttgctcagttcaaaagattcgatgtgagacccaagtacctcccattaccccagatcaccaaccatacctgagtagcgcccatacgtctcgtttcattggctatctcacggacggaggacacgacatattgtgtatgaccagtagttctttgcaactgaccgaaagcatgctcgcttgctcgtacaatgcctcttgcagcccacttagacaggccggtcccggtcaccccgcccgttcaccccagggccagacgcacaaaccaacatccttcatgcgcacccattttaccatgacagaaacgcagactatgactggctatgcgcggtttatctgtagattgttgtcagttggctatctcgatgacgcaatgtggatcaatgagcaatagagcccagatgtgttatgcagtagacattgattcacccacagcgtgccggggatccttcgaacccttatatttcttgtccacaataatgagtcaaagcgaagatattttgaagccctaataggtaagccgaacataataaacattagttatttattcatgttaccaattgaagcattattctattcaccattaccggtactatgcgtacgatgagccctccaatctggcgttgcgtgtctttgtcactcctcccaggctcgaaagatgccaaaacttccaagtctcaatgagagtatcccgctctaatcccttacccactaaatcccatctgaacaagtcccgggcattcttgatgcgaatgactcagaagtagtcaggtgcttcagggcggccagcaatcctgcctttgccagccctacccaacggaatgtgatgcacagagttcccaatcttggccttgaccgccgacacgtcaatctcccacttccgcacctccgcgtacttacttctcttcaagaccttgatcgctcgtagactcatctcctccccggggacgtcaaacgtccaaccgatggagacgtggaacgccacgcccaccgcctcgtcgccgctgctgccgtcgtcctcgcggtgcttatacagcggcggctgcccgaactgcgaggccacgccgttgcaccgcctgagcagcgccacgagctccgggttcagcgcgccccccgcgtccttgccgccgagcaggtcccggctgctcgcgacccggatgatgaggaagatgcggtccgagtctggggacttgtaccaggccagggtgcggggcgtcacggcaaagggcgccacggcgccggcctggatggcgccggacgccttctccaggaagtcgtccttgttcgccgtcgtgaggctcagcggccgggacaggctgatgtgcaggggcaagggggagccgaggtcgctcgtgaggaagttgtgaagcttgaccttgccctggagctccgtctcaacgtcctggactagtttgacgagcatgtcgtattcaggacttgtgagattccctggtgatcacgtattagttccgtatgcctgtggtctcgagtgaataagtaatatataaacgcacattcaatgtagagatgggacggccaattcccaacaatgtgtggagtctgccttttccggccatgatgcagacttgggtcgtcaaccacgctctggcgcacggtggaagcataaaggtcgtggaatgtcgagggcaagggaggcatcacagatcgcttggtaggttttccatcctggccgtcgaccttgacagcgcgtgagctaggatggctaagcgtggaggtctctgagtcgcctgccttccggcgtttggctggaggttgctggtgaagcgactcggttgaggctgagctggaggatgaataatcgaccaacgccatgtcgggcagttgatctcgatgctgagagctggactctaggtcccgggctggctgctagattactcgcatcagttgttgccgtgtcggggacagacgagtccagatatcgccgccagatatttgccgttgggagctgaaggctcttgtgcatgaattaaaattggctggtgcccagtggccgttaccactcgcatggcggcctcgcgaacgatcgagattcaagagcgagcacagattgttaggcgatggcctgaaccctgaggcgctgaaaagataggggtatcagaggaccgccctccaagatgatgggaaaacgaacaccatctacccgtctgatgaatttgagggtatggcatatattatggtcattattgatccatggaaatttcatgatcatcaatttcaaactgaagctcctgatgccgctgtgggagatggcctccagctgggtctggtgcttgtggagctggggattcctccagtggagactcagcgcctgagagcccagtttacaggcacttagggcctcactgcccacatcacctaccacttacaacctctcctcctcaagcagcaacatctctccccaaacgacagtagaggacccagtagctcgccacggtggttaatatgctgaaattgcgtaagtttccttgggccaagcggccaaccctggtagcatcgaggagagttttgtcgaagccaaggaggttggcgtgctcgtgggaccaggcccggaacttgtgttagctacatacctatgccaattagttttcctttataaaggcagggtagttggttgctggctgctcgaattcgagatgccttcgatttatgcgaagctcccacaaccccggagctttacaaccaaaaattgtgttccatcttcatggatctcgcggaacgagtgatagggagactcgtgtcagcgtgtccaaggcctcgctgaatggtgctttagctggcatgttgacatgaatcaatactttgagatactttgcgactgtcttgaagaacgtaagttacgccagctaagcctagggaaagaagaataatacttcgtgaccctcaaacctgatggacagcataagcatggcggttttgagaggagttatcgctcaaccatcaaagggtttacaagcctattttggagagcttgatccatgctatccagatggtgtataagtacagttactttcatctctcggctgacaaaggtaaaggcacggtggaacaaggcctcattatagcagcatggtctattttgatgcaggtccgaggcagtgcgatttgaaacatcccctaaccttgaacttctaaaacacaccgaatggacgtttcatataatgccaagaatgaatgaaacgccaacatggcctgtagcagggacagatctcacgtacgatggtctgttgagcctccaggcccttcgaaagcttgggccctgcggcctgtccctccgtctggagatggagtggggcgtaaatgcaacccgtggccgcgttaaggctggaagcgaggagattttcctactgccgtcataggctacgtagctctagacatgggtagtttcatgtagttcgcttaggagggcgttgtcatgtcaagtagttcggatttttagtcgaatgatgctcggttgagtcaacggaccgtccgggtggattcagctcggctctatgaacaatgatggaatatctcgttatcggggccctcccactcaataggtacttggcagctttgtccaccggagtgattgcttagtggactgaacatgtttcctcgtacattcaagcaccaacaatatcagaagcggtcgatgattaaatggtacttctacaggtaaatcttgaatttcactgaaaattaccagcaaaatcccactagaaatagccactcaagtatttagcatatagatttagagtgtttggcagctcatgatgcggtatagggtagatagcctagatgcactgccggcttcgttaagtcgggctaattttggcaagcgaccaaggattcctagacgaatatcttctattcggtgacgtgagatcattcagcgatctcctcgatcagcgactcgccagtcgacttgtcgccgcttgtccattcccacttctcatgcatccgcagcctgccatcagcaagcttctccggccgggactggcagcggcccgtcataagctctcccttggtgttgacgtgttggtagcgcatgtcgaggctgttgtcggacgccacggttgctattaacgagcccctgacaatagagccgcccgagtactcggcccagacgatgtccgcttgttggtggtagtggaagagcgtctcggcaccaacctcaccattcgccgtgttggtcacagaccggaaggtcttgccgtcgtaaaaactcattttgtggttgctggattgaatttgggtttgacttttattgagttcgtatgttgatttttttggtggcaataatttgcaagttaagtgatcacaatgcgaagcctattattatttaattatcaatgagtttcaaaatatcttttaattgaaagcttggcctggttgaagtttccgatgtcggccactccgtaacgaagcagtcatgacagaaacactggtgactctatcatgatcccgtatgaggattaaaaagacctggaaaagcagcaattgctcacatcaacccactcagtaggtataggcacctgctccaattcaaaacacataccgtcgttccaagctgtcaatgaatgcatgccgcgatttgccccaaacattcgggttaggctatccgagacagaaggtcctctaccaatgcaggtccagcgccacttccaccccgcgtcggtgccgttttttggcttcagctgtttgagtcactcaagatactctatttggccattatccccttgagttttcccactggcctggaccttgcctcgtgcccctggcccaaggggcaaagaaggtctacggacacttgagacgaactttattttctgtcccgcgcgaggtgtgtgtgcttggcttcgggaagactggaaggatcttgttggccctggaccctggacggtcacataccttcagaccgatcaccccacagggcgtcatcccggctgcccagatcctgtgtcacaccacggcaagctgaggctttgactcactagtgggctggctagctgcctgacattgagatggcctgtcccatcacattccattctctgggcgctggatcaattcatccatcaattgtcagatagctgtctgtctgtaagtaagacaggcagtgctgctgtaagccctgcactcagaacgcggcgatctgctcaacgacttggcgaaatctggcccacctccatcagctggcggaggatgactgatgatcgaaggctgccataggcctggtctgacccgggtggcggttgtcacatgggtatccgggggcttccgtgggcctaagcgcgtgcattgaacccaaacccgcctctcgctcttgtgctttcttagctcgccagctggccattgtaaagcgccatgctgcatacctgccatggtcgaggctctgaagttacttctggggcggacggaggtggcgcctgagcatgtctgtctgtgcctccccccgggcgtttagtgcctgtcctggcttgtaaaggacatcctgggcgtgcagagtgggcggtttagcttcgctgaggctgtcagagaggcagccagagttcccgtggcgttagttctctgcgtttgcccggggctgtccctattgaagagtgatctgagcctctctattgtcctcaagtttgcattaaaaccccagacatccttccctcagctctgcatgtttcacttcaactctacaactcaacatccatctcgtctctggcagacattgaagcaagcaacgcacactttagacaccagcaactccaactcgcaatcaggaaccagtctacttgatcttgtctgcagtagcaacactagcacttgggtcacataccatcactcaccacgaaccgatcttgatcaattcgatcgatctgctctattgctccgctcgctgctccatatagtatctccaacacacggtcggcatccttggacaccatcgtcatcatgtcgctccccactctcgacggcgagtatgataagaactgggtatgttgtggtgtggtttcctttcctcatttgtgcttccgtgtggacctgcttcctctctcttccatcatcaacgctcgcaacccaccctgaacccttccgcccacgccgagggggaagatcggctcatgtaccctcttttcggggccatcggacgagtcgtgggagcagcggcagcgtgatcggcatgcggtcacaggccgcgtcgtcaccctgacaaagcttaatgtgctagtcttggaccctgagcgaggtgcccagcccagactccagcggcttgggtcctgcgtggccagtggctttgccggccgacgatcgctgacgacaaccctcccacttttttggctcttctctgcccgtgacctcatccatccgctctgctataacatggcgtgtccctcgtcgtttgtgcctgaattctgctaaccataaccaattatttaggcccaaaagtatctcatcgagcctctgaccagcccagagcccagccaaatccactttcaggaatcagccccacgcccatctacatcatcatcagccaaatccagacctgtctcgcggcctgttagcattatcaacagagacccagtcactggcaaattcgtattacctattgagcccgttggcagcccagccggacagactgcttgggacttccatccttcaaatcccttctcctcccactcccgcacccaatctaccagccaagtccccatcgacaccaagcctgtgactttggatccatttacaccaactcaccgtcgcttccactctctgccagagcagaacttgagaacaatggctccccgcactcttgacactattaagaaggagcacaagactgctcaccgccgtcaccgctctcgtccctcacagaccgacatcattgactccctcgatactgtcggtggagcttaccaccacagtggtccctatgatgccgcttctgccagcatgaacacccacaagaagtactcgcccctcgaggccgtccgtgactccaacatggaggccctcaaggcaacccctccggaatacatcaaggactccctcgagagaaaccttcccctccaaggcacggctaccatccccagtggctacacagacctctcaggcaatgtcatgcaatacgaggagggaaccgatatgatgcgtgaccctactgccgggggtggtgcttacaagcggtgggacggaatcgtaagtgaatgcataaactccgttcatcccccgttcatgcatgaccaagctaaccacgatgacgtccagacataccaccctgacgacctcaagggcaagggtagcgagttcgaatacgagcgtgacctcaagctcaagaaggctcaaggtcaggaggagggagttgagatgctcccccagcgctccagccacaacttccgcaatggcgatgatcgcgccacctctgccgttgacggcatctccactggccgacgggtcgccgatggcgttaagcgccgccttggtggcctgtcacgaaagagagatgtgctcgtcaactaagagcatctctctaaacatactcagacactcactcacacgcaaaattttccttatcttatgaagtttatacccctggaaaattactgtactattatgacgacgatactttggtacgactccgccttatcggcttgacagcgttgcgatttttggaaacttgctctcgtttatctgcggagagctggctactactttactgaattggttattgggagttttggattacagtgtatatcagcacttgggaatttttttatgtcatcaagacgggaatatcggtcaataaagagatagactaaagactgcttcaacgaatagattcacaatatctttcaatccgatttgcacagtgacagaatattgtcctcattcttgattgtgacttgggtttccattctcgaactagggaatttcattcaccagtattgactaaatgtcatttaaaacatcattgagcaccatttgtaaccaagtgttctcattgtacttcattttagaatttggcttctagctacacactaccaatagatctcttttcagcaaattctcatccataagcctccctttaaaaataagacaacccgctccatccgagcacgctgtgcaactcatctctcatttcctgaacgccatcataaccacccttcgtagccagctccgcccgcttcgcggtgcccagctcggtccatcgcgccaggacctcgccatcgatgatggccgcgctgcgtcccgccgcggtgtcgacgccgatgctcctccctgccgagttcgtggcgatcgaggacgtggaggggaggcggtgggccttggagttgagacccgcgtaggacgggaggatggagaggagctgcgtctggagggagtatagcctgcggtgggccgactcgcttatggcgctgagggacgagaggtggccggagggggatgagaggaggaggaggtgggtgttgatgtcggaggagcgggggaggagaagggtgttggttgccgggttgggggtgagggagaaggtggtgcggtggaggagaagactgccctggaaggacttggcatctgtataggaggttagttcctgaagcaaaagggagagaatcgccagggttgaagcgtagtggaaggggaactactcacgatcgggattgaattcaaggatgtgcatatcaccatcagcatcaatggcgaccatcacaaggtcctctccatctggaaggaaatcggccgttaggatgggcactcggcttccactcttgccgagaaccttgaaggtatacggctcttccgtgtaaccggcaaaccaaacccccttgaatgtgtcggcaagaaggcatagtccggtgcgcgggagagcgcgggcagatgcaacatggcaattcatgtccaggaaggctactggaagtagcgagccatcttccttgagacctcggaccatgcatttttggccctgtgctactagcatcaaaccttgcgtcccaatctcgctgagagctgtgacgccgccccgaggaatatcctcctttgcgacaggcttcagcctgcggttggtctcgggatggccgggctcggggatgactgtcacaatgtcgagaacctgaaccctgcctctagtaggcaggtcctctccttttgacagagcagatccgacagcgagaagcatccttctttccttagtctcttcggacacttccaggttgagggtcttcatgctttcaatagtctcgctcgactcaagctcgaaatcattaatagcggtccaggttattgggttgacgagcttaagaacaccacgagccatcgttggcgcgaagggcaaagtctcccttgcccattccttgtggtaatcgtcatcccgagggagctcaaatggctcggcagtgaggcatccggcaacgtaggtttcagtggggggatggtacgcgatttgcttgacttcaacgcctagaggaacctttcggacggcgacgcccagttgtgtaaagtcacggttaggaggtagctgagctaccctcgcaatgccctcggaatcggcatagatgaagcctctatcgcagccttccgtgtggaaggagctcatgccacggactcccaagccttgtagcggcacaacgcgaggaacgctcttgctggacttgatgatgaagcttggcgagggcccgggcaagaagacagtgctgtatccttgaatattttgactcggtcttaggggaacaaatcgtggctgttcagattcatcatcttcttctttgacttcctcaacaggttttctggccagtacgggattagaggccttcttgaaaaccaaggtggtgcttagtgtggaatcttcgccgtttgacgaccgtagcggctcatataatgtaatatcatcatttgaatttcgcaactgaaacatgttagggtattgacccagcgctcgaatcagattgaacgatacttacaatcaggtatggtgtcagtgacacggtgtctcctagatctgcaacgagacactctgtgaaagtatcacgaggcgagccttttcggacagtgaattctgttgagaggaaggggggtagatacgataagccgtcggaaacgaagacgggtttcgaaaggtcggggagcgcgtaaatctagtctggtcagccttgcccagagtgtcttaagctctctcaatgaaacctacgtgtaaagcaccagatgaactgagcaagaacatcatgatggtctcgccagtaccactacctttcgagctttggaagacacccttggtatccttgtacaagcatccagaggaccattttgttgaattcagagggcttccatccttgtccacttcttcgagttcgttattcctttgaatctgtgcaaggaatatgttgctgtcatcccgcacaagtaataagtacggatcagagatgcttgcactgagtactcttggctctgtatttgtgtcttcatcaaacatgggcagaatctgggctagaccaagatctacggagagtcagccactggttttcttttgatccaatgtcaaggaacttacctccatcgtagcacctcacctcagatttaagaacctggatgattctattctcattccccatggtgcctgcctcgacagtgaatccggctgctggctcaaattcagtgtccttgatgctctcgaagccggcagctgtcagcgcataaacatcagaggtctcatatccatccaagtccacctttgcgacgatcatgtacttgtcgtagtggccagcggcgtcataatcatggccagagcccgcaggcgctgttaacgcactcggggccggtttcttcacgcgaactgtccagaagcctctcgcctcggggaactcgaatcgtccaataatcttgggctggacgccgcaattgatcactgcgatagagcctgccctgccctttccgaccgcacatgcaagctccagatcagcggtgacaccctttgccagagttgcctcctcgctcgacagtgcaaacgcaggctttccgcaggtaaaatcgttgattggtgcgatgcagatgagggtgtcatttacgcggaaatgtaaatcgcctgccttgcctgattcgttggctgtttgtatgggcttcgccgctgtggatgcgttgccataaagatcatcgtcgtcgtcataatcctcgatgtccatctcatcaatgtcaaggcccagatcagggtcaatgatccggcttctcttgcgcttttcctgtgactgtcttcttgtccagccgagaacgacggaatccccagtctcacttccaatgaagcatgcgtttttcccgagcttggatatgcaagtagccctgcttttgaagagattccctccacactcctcagttactagccttaggctgagtccagacactgtccgtccgtcaattctaaatgtgatcatgactagatagccttccttggtgacaagaagaagctccccatggtctatggaaagaatctcaacggtgcaaccttctagccgcaggcccaagtcggattgatcgaccaggttgaacgatgtaatttgtttagtgatggggttcacagcaacaccattggtcctgccggactgatcgacatggatcagctcattttctccaagtaacaaggcaccgccgattggggctggtaagggcatgaccttgaatagatctcgtgggaggtctgtaacggagaggatcgtcgtcgacgccttctgctgtaagtcgagggtaaagacctggtatgacaggtggtccttagcaccaagggcagcagatgggggctgggttgatgagagaattccaaaggtaggctcgcggtactcatggaggaaggcaagatggatcggatgaagcagacttggttcaatgagaggaaggcgaaggacaaatgatgctgtatatgcttgttctacactgtcgctagtcccgtttgcaaccgcacccgcgtttgactctttgaccgggcgaggtccatccaagtcctcgtcccaatcatccatctccaagtcttcctcagattgtcggaatggtagaatagcgaggttgcgagacccaaatttgaacgcggcgcatcgactcccggggtcagcgtcgaggtaattgacgtattcgttgagaggaagttcccatggagcagcctggatgtcatccttttcataatagtgaagagatattgtttccagggtgttgcgctggggatcccattccgtcaagcagagtttggcagctttgtaggccagcaacaacgcttcaccgccagaagccgtattgctgagcttcagcctcgccattccaatgacagttcccgcaagggggatctcggcgacaagaacaagcttcgtattgttggatcgatcggtccggacaagcatggactcgccgcccagaaacgaagactcgaggccctcatcgtcgttgacgcggtggtcgtagggaatctcagccttggtagatgtagccgtttcgtccttctgggagtcgagctcggcagagacagtcttggtagcgaagatctggaggagggatccctttgcgacaaccaggttgctggccgcggcagaggttagcgggagggccagggagtaggagacggcagtgggagccgcaagctcagtgtaggcctgcatcgcagcgacagaatcattattccgcccggacgcggtctgctaagcgaattgacgtcggtaggagctcgctcgtctgctgctgttcggtggtgcgatgcagtcccgtgtattgaggccctcgatctgctgcttggtagtattttcgacctggaacaattggcagacgcgctgtcgcgctagacctttagggtcacccccagtgtgtgctgtagccgcagctggtcgcagcgctgagtctggggctttgggtgcctggaggggtgagtctcataatcccagggagtggtatcaaggcttacacgctagtatagatacgggtagttgtacgtctccattgcgtcagagatcaagcttggcagctgcatctgcgctcgctcctcccccaaatccaaagacaaacaacacgactggattcctgccttgatttattgtgcttcttacattattgtatctacggatcacctccttcttcgcctgaaagcataagcgtcgctgaattcattttcttctgccatcggtcgcctatgatcaccagcaaactctcgacctccccgagctgctaccatggctgacgcaggtttgatccataccagtctcatctgggtggcgtacgccattgctgtcgccctctgcctagtcatctccgtcatcactaccttcacctggcagactcctcgggagcgttctgccatcgtcagcgtcgtctcgatcatcagcctgacttcgttgctcgcgaccgtgcttcttctccctgtcgacatcgctctcatctccgctacgtcatccgcggctaacggggccaagaaggaatgggccacccccgaacgcatcgataatattcttctcaccctcaagattgtgtactacagcttgtatagcttcgacgggcttctttgcctcatcgtgataccgttcacctacttttggtacgaggagtacgacgagatcgagttcgaggaggaaggccgaacatggaccagtcgctttgtctcagcagccaagtacacgctattcttcgtagccctcgtcgtcgttctgttccttcttggtttcttcgtgccagctgccggtgacgattcacaggcgcactgggacctcgattactacaagaagctcatatcccagaatcatggcgagaaggcgcttaccttcgccttgggacttctgatcaccattggcactcttctctacgtcgtgtacaccggtgctgggctcgccctcctcccaatctcctggatccgatccgcgccggcgatatctgccccacagctttcagagacaaccgcatcccaattggaaatgaaccgcgagcgacagcgccaaatcgaaatgcgcaatgccggacgtcatgatgaaatgcctcgaaaggaccgccgtgagttggatgctctcgtccgcgaagaacagacacttgtacgaagggagcgccttgctgctgaggctcagggtgagggccgaagcgccgtgtaccgcttctggttcaagctttgcgcattattccggccagttaagatgcttggtggccttctgctactggtagttgcggttctcatctgggtatctatgctcatcacgggaattgacaaggccaagaactcgatctgcaaacagcgatgcggatacattctgggtcaaatccacatcttccagccactgaactggattttcgtccagtccgccaaggttttccctattgactatattctaatggtgcttctcgtcctctttctctttggcagctctattacgggtgtggctactgttggaatccgcttcttgtgggttaagattttccaaatccgacgtggcaggaccgctccccaagcacttctcatggccacagtgatgctcacgctgcttgtgctggccattaactacgctgttgccatgcttgtagcacctcagtatgctacttatggcacgcagaccttctgctcgaacaaacccgcagttcccggactccaaccggactgctcgggtcataaagatatgattttcccctgttcagaagccctgaaggaaagtcacgccaaagatgtttgcacaccgtctgtgatgtccacattcctcaaccgagttaccattacttggcccttctttggaatcgtcgatttctgggcacaatttggtttcctcctggttttcttgattgttctggttactgcaatcattcgagcacccaaggtgaacatgtctgaaattgacgaagatgcggaagcggatgaggaggaaagccttttggcaacgacaggaagacgctttggagcgacgtgggaggatttcaggggcaagacgtcaaccagcaatggtggtggcacagagggcagctcgtcttcaaatcgtgtttgagctgtgaccgttgtgaattagccgctgaattgtcaggcgagggaatttgatttggtattttgtttggaggctcctttgtttttctttttgggatttgcgtgcatcatggaatatgggaggtttcggtaactggttattctccatttggttcaagtttgtttttctttcgtcttgccgtttggttttgagacacgagctttatgtgaaaattggcaacagtattgttttctatctgaattctttgattaaagagatttgtcatgctcctaatgctactcgcttctccttcttcccctctctcgtaaagtaaacggctttgtgatctctgtcatcaaacgccgccgttggaccaaggtgcatctcacgccaacaccgcacacaatatgggtcgtcatcacaacctaggcatttcaacgtagcgtcttccaggcaaactgtgcaccatgagctcatgtcgtcgtctgtgtatttggtggaggatttcagtcggttgggctctttggctggcttggaggtaggtacggaggggagatcgaaagatggagacgctgaagatgcgcgtagtgcggatagacgagccgtaatgtcatccagagtattcgatgagggggcggagctggggacttgatctggggcggcgaggtcttgaggtaccgagggcagctcgaggtctgcggcggctcccgaagtctggcggttgtcgccctcgtctgaggaatcctgctgctcttggccggtatccatttgattatcatcgtctttgcttccctgcgctgcttccacttcgatttcgtcgcggaagcgggcgatgacatcgtctacctcgtttgtcatcttctccccgtctgaatcatcgtctgagtctccctgcgcggcatgcgtctttttagactctgaggattcatcctgcgggatggaatgtgatagctcctcgagcagtgctttgaccttggcgtcgtccggctccagcggcggctcaacaggttcatcatcgggaccgacatcaccaagcagctcttccaaggtgcggtcgtctgtcgcgaaggccgcctctacgtcgtcgtcggcttggaaggagtccttcttctccggcgcctctggtctgtgcccggccggctttgacggggttgagatgtcccgcgcttgcggctgtgaggatgacgagggggatggcgaaggcgatgtctggtcgcgcagggccttgaggcgggaggctaatgcatcttcccgggatggagtggcgctctttctttcgatcacgtccacgtctatcctgtggcggggttagcatttcattctctcatcaagatggtagtaagtgcaaaaaggaaaaagaagacatttgggcgccagtcggactatagtgtgcactgacttgacaggggcttctttcttggtagttgggcttgagccacgcagagcagcgagccggtccagaagcgacttgtccatagcgatactaccctgtggaatacttcaggttatcggtggctgtgtttgtgcatggaagtctagatctccccgatatcgataacatcgataataaactgggaatggtgtgaggcgagtgaggctctcatcgatgccgcgtaggtgcttgggagtggagcggggttcggccgttcggcggtcgttggcagccgttggccgtgtattttccccgttcacacacagttgtgagagtggcttgaactgctgcacttcaagctgcaagtcacgcatgccaagcctgccaagccggtcactcattttcttaatttgacttgacagtttgtgaggaaattgtttttctggattcgcagggtggatagcccgaagcaggacccagaatagggtctgaagatgcggatgaggaaccaagcataaccaaccctttgattctgcatgcgaatttatgacctgttgacttgttgactttggacagaatctacaatctagaccaggtgttgagaaccttgagataagttggaattttcatcttttagatgttgtactttaacccacagtattgggaacatgttctcggatagcctactctggacatctcacggcaaagaggaccgacggataatagttgagcgacccgggccggcacggcacatgaccggatttctatgcagccccggcggaaatggactgactgactggcaaggcagaaacggccagcggggttgccatcggtatcaatattccgagaagacgaactctcccggacatgagacgggcgaacaacgaatcctcctttgcacagagaggggagtacactgcactggcagatgatggatggacatggttgcttcgttccgtaattcggttcgaaaactcgtgtctcgcgttcagagcggccaaatccgcagacctgtgatttggctgaccgatgcccttgcgatgtaagaaaggagtctcactctcattgtctaagcgcccactcgaataagtgtgcctgataatctcaaccgtggcagttattggaaagcaaatgagacgcagtggtccgctgtgggaggcataactgggcagttgcaacatagagtgagcccacccttttagcacagccttaaaatatctgagttggtgttgtacattgacaggcctgggtgcaaaagaaccgttttaccttctagaatggttacatgggccgttatccgagccccatgcttctacatgtgtgtataagccagccaattggctcttcggaacctgtctgtgatccccctcttcgggcagaacagatcaaaacatcacttgatgagctgggctgtgcacctatattgtttggagaggtgcgtcgggcatggttgatgttcgcccctgtcaccatgtggagattcgctagctggaatcatgggcctgctcactgacccctgacatacatatgagacggtgatatgaagttaaagcagtcaaggtggcagtgaaccccatcaatcaatctgggaccccgcaaggctgtttggcgcggcgcggataagtctttgggtcatcatggactgatgagccatggctgatgttggccgtgactcgcgaaggtgagattcacggcgcacaatccaacatgtggtcaatcaacgggcgtttgcttatttgagaacgcccatggtggattgaaagagaggacaaggcaaagcaaggcggaagagagggcgtttgggagagccagcaggttctgaaggccaggaagctgcgctcgctgtctgcccgccttcacctcactcaatctacatttacatttgcctaggtattgatagttactcatcaaaggcttaatcaatatgatgctcgtataactgaacaaaaacacgggaccgatctcggcctagtacttcggccgccacgccgattgccacaaggagtcaatcagcgtcaatgatctgatcgaagcagcaaggatccgcacgtgttcacgaattgccacaggacaagcttggcatgacgctaagattcgcccaagagaaagggtctttctgtacgagacgccacggaaagcttcagtttggcaaggctaggcagttagtctcattgttttcggtgtgctagttcccttcttagccacacagagatcttgaccaaactactacatgaagaaatgagatgggtttctgtctgttcagcctcgccgctcttcctcggacgccatctctgtggggtgtctttcaagggacaagcagcgccaaagtagttgggacaatgagacgctttgctcatactcaggtacatacatatgtacttagtcagaggataagcttccatggctatgttctctaggaaccacgctacgacgtctaggcttccagtaaggcgcacatctgtaattcgacaacagcaggtaatttacacgagagattggaatttggcttgtttcagtgtgaggaaggcccgcgcgcacattacttactattttaggtgcttcaagcttggaaatatctgcagacagctcgcatagacgatggatgccctgggctcaatgggaagtatcagcctggaacttcctacgcgcactcgctagcgagcggagcatgaagtggtgatgtgtaccaattgttgctctgcgccatgttgcatacaacactacaaaccaggtagctggaaaacaagtggcgtagggctggtcagattagatcatgtgttatatcgtgactgggcaatcagaaattatacagttgtacatcacttcagattgggaaatatttggcacaagcttaaaagtggcccctattttcaattggtttgatcgccacctgtgtttcttgctcggtgtgccctgacatcatgaatcatcttcagtggtggtgatcagcagtaaattttacagggcctactgctggccccagtcgctgagccaaagtcatgtcatgtatctgcagcgtgtttaatggatgttttagcagagccagggccaagccggaagacaaggagccacccgcattctgagtagctgtgtttggtgctgatggaccaggagcgtggagaaggattactggttgctttattattagagggctgacgcagggttgttctcagctcctcgcgacccttgtaagcgattctcgcagcactactgtgcaaaaggaggcctcacttcaccacgaacggggacgagggattgcgacaaatgtggttgtttgcgtatcgaagggtttcatctagagagtttgaacaaacgccaaagctggggtacttactgtactgcctgtgtttctcagtcggtctgccctactcagcctccggatttaatgcaaggttccctcaagggcaggtgggttcgacattgcccagaggctaattaagctatcccatggctggttagccgatccctgcgcctgccgtagtgttgcagaggtacattagcacagccacccgggctgccttgcaaatggaccatgtttgttctgaggtcattcaatttgtgattaaccttacaaggaagattcgactactgatatttaagcctattcccctcgggcttcccacattccggtgtctcatctcaaccagactgcttaaaatacacttcagcccgcatccgacgtctctcaaacaattgacgcatacagtattgagttgattgttccttaccctacgaccaagaacatacttggcagtacacagttacctacctagacacatacagcagccatgaggtcgcatctaaccttcatcaccttcatcgccttcctcttcggcctgacagcagctctcgccatcgatgagtccagacttcacaaagatgatctcgagctactgagcgcagagctccaggatcgggactccgacgcgacgcacgagctctggaagcgcaagggtggaggaggtggtggtcgtggtggcggcggaggcggcggcagcaaaggcggcagcagcagcaccagcagcaagggaagcagcagcactgcctctcgaaccaacaaggcgtatgtactcagactgccatcgcagaccatggatggatccggctaaccctcacattgcagatactacccaggcgctcaaggaggcaacaccggaggctactcacccggtggctccggtcctcagcctcgctttgtctcaaacacatactatggcggtggtgcaaaggctccttacccagccggaggcagtcccagcggcaagtcgatgaccagctcccgcacagccagtcccctggcctactaccccggatactggccaccctatcccatcttcatctacccttacggctatcaccacagctaccgcaacaagacctccaaccagaacgagacgcgcgaggtcatctgcgcctgccctgagtactcttcatgcatgtgcgatgatgttgaggacaccaagttctgggacgagctcattggcgacggcgactacaagaagctgaacaagtctctggtcaccgtggctcaggttgatggcaagaccaagatcgtcctcaacggaaccgttcccaacggtaccaccaccgactgcaagaattccaaggattgcgaagcctactatagcgatgccgccagcctcctggttcacagtctgggtttgtggcccgttgccttcactgtcttcgcgagcgtcttcttcctctagagcgacacccggagcatcctttcctcattttcttttcgtgtacttttgaacaagtgacacgcatgaacgggactgcaagcgctttttggattgttttgattctttttactctctttttactctacccacgggaaacgaccagttatgcatatatatatcacggcgctttggtttgatacttgatttgatttttgatagacttgtggacatcactgtcgggggtaacgaagggttgcccacccggacgtggcttgggaaaatgtaccatatctacagagcaattccatgatacccataacaatgtcatttttttctacctctataatctatcctatgcattcatgatgtgttgtagaaatcgactatgctctaaataaactgtgatcatcatgatttagtcctgctcatctaatatctctcctcgcgagagtaagagcggtattacttcccctcacaaattcccgaactcattagccagcgaatacctctacttactttttaatgcctcgtccagcttcaactctaaaccccctcaagctaacatctcactttgagcttccactccgcacgcagccccctcgccacaacatgcatcacacagcaacacagagcagccacggcagcccacacagtcgcccagcgccactcgccccccgccgcctgctgtatcagtccccctatcggcggtcccgtcaacccggcaatggaagcgacgctgaagcacatgcccatccgcgtccccaccatgtcgagccgcttcgtgatggccgcgatgcccgtgctgatgagggactggtacccgccgttgacgaggccgtacgtgactgtgaaggcgtacacccccggcacgtcgcggacggcgagccaggagaaggctacgcaggcgactcccgcggccgagagggtgacgacgttgaggacgccgaagcggtcggcgaggatggggacgaggacgcgggtggggaagcccgcgccgttgattattgttacgaggagggtggcgtcggcctgggagaggcctattacctgctttccaaaggatgcgacctgccgatggggtgttagtgaggtttgtaggctggtggaggggaggggaggagaggagagaggcgcgtacgtagtacatggtgtagaagacggtccagatgaagaagaagacgccgaagacataagtcacgtagatgggttccgtaaaggcggtccagtcgatgatggggccggatctcctgggcggtagtctgggacgcatgaagctgacgacgagtaggaggccggccatgttgatgaagccgagcgtcagggccgtccacttgaagcccaccttggggagcagctggcggacgacgagggggtagattataccccccgccgagttgccggtggtcgcgatgcccatggccaggcctcgtttcttgctaaagtaggtggccatgagggcgagggacggggtgaagaagatgccgccgccgaggccggtcaggactccctgggtgagcatgaggtgccagtagctcttggagacggccatgaggaagatcccgaggagctggaggagggcgccgatgacgaacgttgggaggaagaagccggcgtcgagcaggcggccggagaaggcgccgatgaagtaggtgagccacgtctggatggagccgatccaggagatggccgaggcggactcgggcagggtggatgtgtagtagacctggaagctcccaaaggagttgatgtagccccaggtggtgaagatggctacccagcccatggcgacttggagccaggcgtggaggccaccatctgggggaggggaaacggcgtctccggggagaatttcatctggggtcgttgcgtcttggtcgctatcggtgtgaacctcccggatccgagtgtgagaggggacctttttggcttgctcgttccgttcgagtgagctcagcgtatgggtcgcattctcaacatcctcgaatcgaggcgattctacctggttcacagaattgctcgccatggcgatgattcatcgaggacaggggagtcctctacttttcagcatgagaggctcaactggagaagatcacaggaagggagcgagaacagcgagaaatgggggcaattggactctggaatcttcagttcgctatatagaaccatatataacaacggcaacattgggggaaggcgacattagattggtatgagaacagagtagttggcggagtggaacgtggaaagcccaagatcaagcactaggagcggtatgcgcaaaaggcccctgcaagttgggcgacaaatcccgggacataagtatttacggccatgcccactattatagagcaagcaaaggcgtgtaattgtgcctttcctgggagacccgattcgtttcttcaacacgggtctagctcggaaaggcggtgccggacagaggcccacgaaacggtcccgccagttggacggcaggacggactaaggtccgagtttcggagaaggcagagcgaaagagattgagcacacggtggtgtcagtctgctcctggattaccccaacgtctaacagctcatccagattcccactaatcaacctaaactgctgttcaactggttgccgcaggggaaagagttgtacaggagcactgtcagaggatggtagagacctggacgcttgtttgggccacatggccttggatcggctcggaatgagtccagcttggcggccacttccggctgagcctccgaatcggcagaagcaacgcagtcccgagcgagattattagacatcttaggaaatatctaggaccagagcgcgatgttgaagcttcgctgattgataagtaacagtggctctcgtgaaagcaatgtgtacaactgccatgactcagtgctggcgtgacagtgcattgtaccatgccaaacctgccaatgaatctctcctttcataggaaatgaatactccccagggatgtgaacggctgtcttcaaacggttggaccatggacacgatcgcccatcgagaatcgtcgaaaggccgcgcgatcaaggctttctcagcccctagcgtcacctgagtacatctctaacgggtgccaggctcagaccgagaagcattgctcgaactctaggaccaattgaatgcactcgctccggcggttgactcctcctgaagatgaagcgaaatatgacgatggacggaaagcccatgctgtagtcaatagcggaagtagcccgcactattctctttagactcctacgaaccgagggacaattattagaccacttgctttgcaggtatggagtttgatcttcgcccaactccgacgacaaaggccttgggtctgtatattgaaccaatggtgttatgggcgggaggaactttcaaaggcatgattctcagtgaccacacgaaagttcctgagagttgatgccgagtcatataagctgatctaagatcctgtgacaatccgatggtaagccaggcgagaatcctgtcaatcactttgaaggccaacacatacgtgtgcgcatgtaaaggttggaaatgctcatctcgagtattggtttgtggcgacgcccaaatctagactgggcaggcaattctcgtgaggtggcggatcatccctaaattgtggcttgcaatgggtgatcaatgtctcgcctcccggcactggataggtgggttatggtgtcgttgtgccgtgtggtggagagctgaatgcgagctgcgtcgtgcgtgtctaggctacggtagcagtagtctgccggcagagaggaaagggggaggagagcaatgaagcatcgagagctggatcaatgccattccgactgatctaccgtactcatcgtagaagcaacgtgagtaggtagagatccgagagatcctcgctggcatcactcaagactgggtacgttatgcaggtaatgtgcctgggctgcatcagtgattacgtaggtacctacaggctgctgcgccgaaagtgggaaaggcggagacgggcgggagggctagatggggcctgtcgccaattggaagaggcgctgcagccccaaaccaggcgccaactaacgtcacgttgtccgcctaccagagcctccccagagcctgacagccaagccccaagccccaggccccaagctccccgtcttctataacccatcgcctgcgtccctcctcgacctttgcacatctcgcgagaggcctcaatcgtcccctcctggagctctcgcgcaatctgaccacctcatcgaaccttgcgacctcttagagcgaccttgtcgcaccgccgccaacatgggttggaacgtgagtcttacgacctcagcccagcctcggcgacagctctcaactgactctggagtaggtcttccgatacttgggagatatctcccacatgctctccaagatcatcctgatcctagccatccaccgcaatcgatcatcagagggagtcagcttgatcacccagggactctatgccgtcgtcttctgtacccgataccttgacctcttcaaccccatgaaggaccatcccgcgtggaacgtggtcttcaagacggtttacatcctctcgtccttctatacaattggaatcatgcagtggatgttccctcgatcgcgcgagagggagtttgcctggaagatgggcgccgttgtcgcagctggatcactcctgctctccccattcgccatgctgatcttcgagaacaagcagagatggtccttcattaacgtatgtctgacaatgctcacagatctaatctgctgaagaagccccgtgtcgtacaatgctaatttggcctgacttatagtggctctgggtcttctccgagatcctcgaatccgtttgcgtgctcccccagcttctactcctccgccagacgaccgtccctacagtcatcaacagcttctacctcgtgactctcggttcataccgcggcttctactgcatcaattggatatggcgctacttcgacaagaacgacccgggcgcccccctcgtgtctgtcatctttggaatcatccagacagcgctgtacattgacttcgcctgggtttactacacccgccagcgcgtcaagctcaggggtggcggcattgtcgacgccgacgatcttcgcaggagttggcttcttcgccgcatctttggcaagaacgtcaccacatcgatcgacgacgacgatgaggagagcggccctgccctgggaggcgaaagtggcatccgtggcggcagccggcccaagtggggatccaggggcatctccatcagcgccgatgacgacgtcctggactcggagcgggagcacctggcgcagtccgatggtgtcacggactctatcgatccggatgccaagatgcaggatcccgacgagttagccaaggcgctcgacgatgaagaggaggaggaggctggacctgccagtcgccccaacaatggcaacgccagcggagtccgcaatgacgaatgggacgattaggccggatcagaggaggacacctgtgaatttgtggacagaatgggacactctacctatactaaccagatgaataaagagcagagtatgcaaattaggtgtttaagactggacatcaaggctgcctagctcagcatgtacgaggagcattagtttttttagttttttttttggatttggacatgaactcacgatttacacaaagttgtgaatttcatcccattctctgttcttggttttgtatttttttttattttccggttgtgcaaagtcactcatgggagatgtttgattttaggagttatccaaagatatgaataaaatatatacctaaaaagaataagagcacttcttctctttgatcaggtttcccagggactcctccagtcgtggcatctgtgtattccgttcactggaaacccaaacagcttggcccaaacgacatcaaagtatatatacataacgcgcaactaccgcaatcgctcgtaaggcagttgaagacgaaacccagacagttgtagcgatcttaacaaccgattaaacaaaacccaggatgatgataataataataacaatagaaaaaacaagaaacccaagatttgagcaccaagcaaagcctcttcagtgtcatcgggcaaaacgattctcgaactccttatataacttagggctgatctcgtcgctgctcatcccctccacctccagcaggacaccctttcgggcgtagtgctctaggagaggctcgctggtctgcctgaacttgtctaggcggttgcgatagacatcgatgttgtcgtcgggtcgctggacgagagcctctccggtgacgtcgtcgcggccggggacacggggggtgttgaaggtggtgttgtagacgcggccggacggctcgtggacccagcggcctgcgatccgctcgaggatgacggagaatggagtgacgatggagatggccaggttgatgggcacgatggactcgaggccgtgggcctgggttgcgttgcgggggtagccgtcgaggatgaaggatgcggacgggtcctcggaggccaggaggggctcgaagctgggaggggggtcgccgggcgcctcgacgtcggcggcctggaagttgacggtgacgggcgggcgctggccgagcagccatcctcgtgtgtggagttcgttggagatgaggcgcatcatgatgtcgtcggcgacgaggccgccgctcttcatgatcccctctgcttggatacctgtttccgggcaggcgggggttttggttagccaggcgcattcactctggggggcaagaacgccatcttgggacgggatatggactcacccagcgctgtccgtcgcttgacattggtccggagaaggtcgccggtgctgattgactggagctgggggaagcgggcgaggagacgctcgctctgggtgcccttccccacgcccggcgcaccgattaggatgacgcgcgcggccctcctcagctgtgttgtggaggacattttctccctttctgtctcctctaggcgtccgacctctatttgctttgtgttttattactgctgaagatagaatgaagatggtggaaggcagggcggttcgagcggctcgaacggccgagggacggatggaggtgcagatcagatgcgactgaatagggtgggatcggaagcgcacacacacacacacacaggtacgagggaatgaacgctatagcgagcaaatcgaaggcagatccaggggtatctcaattggaagaaggaaataagggacaaaaaggaaagggaaccacaggttgaggaaaagatattacgaatccgtcacggtggtgtggttttgatttgagcaagtgggcattcgctatcagaggccgagtccgcattggcaacgggctggggaggggggcagcaggaagctacagggcgacaggtgtgcgcgctcgggccatttggggccctgtggctccccccgagaccgctctggttgcggttgcgggggtggtgcaggcagtccgatgcgacctgcgctgcccggaacaaatcgtggcacccgccgctacctgaactgattaatcagtgccattccagcacctattggctcgctcttagtgctgcacggggggaggtgtttgatgggactacgcggggtttggcttcgcagctgacgttgcagttgtcgcccattcatgtgttgtcgtcacctcattaggctgctactgtttcatgcgaaagcaaacccatcaatatagacgagcacacgtatcctcactgccacttgttgtcgttatgacaaatatacttgcctgttgtatcgccaatgtatacaattccggagccctggttgatgcagcccagcccagtgtaccaccaatttgggaggacccttgtcactcaccaaaatcgtgaactttgttgaggaacggaacttgacttggcatgtcggatccttcgggatgccgggagggcatagtgccagattgctctgagcgactgctgtgggaccattctaggaccccaagtgggtgacaggagaaacgagacactaatggaagagttggttatatatatactactttctacaataaatagagaatttcagtagtttagatgaaaataaagtaacaatatatactatattatctctaaaatatattttattagcactttgtagcctaacaataccggtcgcagactcggggataagcagcttaatgtttgagtgtctcagtttcaatgtcacccacttggacccttcgacatttgacacaacgcactaagcatggcttggccagggcggccagtgtcagacatagaatggccagatagaaccctgcgattatcatgataccacaccatgttgcagcatggcagtcattgaacaaaccaggttttttttctgctctagaacgacctgctcggctagatcatgatggctaggtacccaacttcccaatccgtctggaatgaagccgtgagatctcgaccctgggccccactgatctgcagtagtctgaagcgagtcacgtgtaaattcacgtgagtttatcacggccaaccacaggccaccgtgcttcgtctcttggtccaatggaaggggattacggctagtccctactcagtaccgagagattcccgactcatgtccactgaagcccagcgaaagtctctctttcatcatcacccttattcgagccaacgacatcatctcttaaccccgacgttcattatcgattccgtcttcatcacagttcgaccgacgccatgagcgcctcatccaatgtggccaggagagcggtcgctcgcaatcctctcttgggtaatggtaatgctcacttcgttcccgttcggactttagaaaagcttatatcgagtgctaactcccgcctgcgcacacagcccgaatcttatcccgcggcatctctccagccatcatcaaccgccatgtcagcagacacgcccagattcccgctctcgccctcttagttcctgcccgatacatgggcaccgagcaccaccgtccagatggccattcggctggcccgccacccggcttcaacgcggagcaggctaagagaccactccccaaggacagctcggcgaccgcagtcaagagtgacaagagttcccagaccaagaagcaggatgacgctgtctcagcgacacccgaaaccccagaggaggccaagatggcgcaattggaggcgaagaaggtagatgtcctggaaaaggtcgaaatcgtcaagcaggagagggaggagaacaagttgaccttgtgggagaaagtcaagcatgaggcacagcactactgggacggcacaaagctgctcgccgctgaagtcaagatcagctggcgcctcgcactcaagatggctgctggctacgagttgacccgcagagagaacaagcagctccagcgcactgtacgcgacttgggccgactcgtccctttctcagtcttcatcattgtgcccctgggtgaggctctgctgcccttggccttgaagctgttccccaacatgctgcccagcacgtacgaggggcaaaagtcaaaggagaagaaggccgctctcttgagatccacacgaaaggaagttagcacttttttgcgaggcacgctcaaagaaacaggtctgccattgagccaagctacagctcacagggaggagtttgccaacttcttccgcaaagtccggtcaacgggcgaagctcctactgccgaggatgtgatcaaggtctgcaaggttttccgcgatgatatgacgctggataacctttctcgaccccagctggtctccatgtgccgctacatgacactcaacacttttggtaccgatgccatgctccgttaccaggtccgccacaggatgcgccagatcaagcgtgacgacagagccattgcgtacgaaggaatcgaaagcttgacggtagctgagctccagactgcctgtgccgcacgtggcattcgtacacacagtgtctccccggcacgcatgcgtcaggatctgcagacctggctcaaccttcgtctcaaggagggcgtcccctcaacactcctcgttctgagcaacgcctacatgtatggccaggagtctggtgaaggcgcaaaccagatcgatgctttgatcggagttctgtcatctattcctgaggaactgttccacgagatcgagctcgaggttcaccatgctgagggtgccgctaccaacaagcagcgtctcgaggttatccgggaacagcaagacctgatcgaggaggagaatagccagaaccatgagagccagagtaccgggttcgccactccccgtgatacagaggatatcgacgaggagaaggaggagcgccaggcagtagccgccgccgagggcgtcagccagactgtggccagcgagatgctggatgcagagaaggaccaggccaaggcggtgcagcaggaggtcaaggcagcccctgcaaccagcgagcagaagtaagggacctgcagcgcgtggtgatgatatatatatatatatcccttcttatccctgctcattattgggcatttcgcatctcaacgacatcaattgtatatctcacatgtatgatttctacggaaccaaagggacggactcggagcgtgtatgaaagagcggcacaaacgcattattcaagaccggtgatggtgtatgcaccgccggcgggggcactggtatagacaatacacaaggtgacagacagcttagactttgctttttctttgttctatcatatttctactctttcatatgaaacaatcgaatacggccattcgctcttacttgcgaggatggcatcattttgcgtcgctatactttaggtgtgtttaattgtgagggatgtgtgtgtgtgtgtgtgtgcgtatgcttggctaaaagttctgtcaagtggctcaacgctgtccattcgctgagaaaaaatgacaattttagtgggcgggccggtttcgagccgacgacggccatccagtttgcgatggtcgcagggctgagggccggtggtcggctcgtcgggcatctcatacccccgacaagacgctcttggcagggcagcgatgcgtcgaagacggtcgtcatgagagaagaaaccaaagggggactgctacgcgctctagatgcagcgacaggtgggggagcatgcccatctccggtctccaaaggaggtgacgtgatgagggtgaagcttcatgattacagcgtgggctgggactggactgagccgtttgagggccgtttcagaattcgagtgggtggcgaactctgtcgtggttctcgtatctctcgccgtttgtttcatgtccttcggcaacggacctggggtgaagctgcaagtaagcagatgcccgtatggggctggtaattcatcgtcagggctcgattaactgtatttttgcttcattttggttgaaggtagagatggaggagtctgttctttttggttcacgcaaccatacacaagccactatactaggtacttcagctttcagaaagcaaatatgtgtgcaaaagaacgcaggcagcagtagtgagggcgcatttctggtaaacaaacagccaatcgttcaatcggccagatgtgagtacggacgctgtcagcatagaacatgagcgtggcaacaattgaatgctcgagcgccatgatccctgctcagactctgggggactttgggaggtttcctttctggcacggcatctcagttcgtgggtccgatctgtggctgggcaaccatggactcaccgtcgtttgcttgtcagcgttcaagatatgttaatgaaatgaaatgaattgttcaagaacagactgcgagtagaaaatcacaatcaatgatggatatgacagtgcagtctgcctcgtggcgctggcccagagaattcagcgtattcaagtcaggtattgaacgcttctgttctaaaataagcaggggcaagctcgagccacagctgctgcagcgggaagtgaggcgggtcactgctcgtcccatttacgatccggggacggaacccactctcaccaaagatccatgctgatggcgatatctgcatctcactagcctgtgatgctacgcgtcgctgggctgaagcagaccaggcctgcgtcgactgcctggtctgtcagcttcgcctggtataagtaacagcttccccttgctggatcttggctctcgggaccatccatctacctcattccactatattacatcatctacgtttccttaagtcataatacatatcggcagtgggatagattagcagaagaagacctggttgtccattcttttagcctcacaataattagccatgtataaacacctcgttcttggagctggcctcctgctcgcctcgacggcattggcagctcccgtacctcagaccaaaataacttccaatggcgggtacattgttgttctcaaggatacggtcaaaaacttcgagtcccatatcgaatgggccaggtcggttcacaagcgaaacctcgccaagcgggacttggacgagagaacatacagtggcatcgacttcacctataccggaagcaatcacttcaacggctatgccggtcacttcgaccccgacaccgttgaggaattccgaagttccggtgatgtgagtggcatccataacttgacaccattttgctcttgacaattgtgactaacagattatactctaggttgactccatggaagaggatcaagattggacaatcggcaccatcgacgtccccgagtcggaggcagatgaggaggaagaggaagaggagctagagacgagagacataacagagcaaaagaacgctacctggggtctgagatccatctcccatcgccaaccgggtggtgacaactacatctacgacgagaacgccggcgccgacacctacgcatatgtcattgacagtggcatccgcatcacccacgaagagtttgagggccgcgccgagcaagcatggaccgcctacggggacgaccacgaagacaagatcggccacggcactcactgcgctgccaccatcggaggcaagaactacggcgttaccaagaagaccaagctgattggcgtcaaggtctttgaccagaactcgacgacgacctccatcatcattgagggaatcgcctgggcctttgacgacatcatttccaagaaccgtattggcaaggccgtcctcagcatgtctctcggcggcacttactctcccaccatgaacagaatcctcaagaatgccgccaggcacggcatcatccccgtcgccgccgcagggaacgacgcccaggacatctccaagggctctccctcgtcggccgagggagtcatcaccgtcggtgccatcgactcggactggaccgtctacgagaagtccaactttggcgagaacctctctctgtacgcccccggtgtgatgatcgagtctgccggccacaccaacgacacctcgatcgtcaagaagacgggcacatccatggcctgccctcacgttgccggcctcgccttgtacgccatgactgtcgatggcatcaccggcaccgacaacgtcaagaagcacctgctcaagaacgccacgcccgacaagatctacggcgacctgaacgggtcaccaaacttgatcgccaacaacggcaactcacaacaagaataaagtaaaacgataaaaaccatttaatgattgtgtctaatttagcgactccttttattttcctatgttacgaaaaatagcatacagcactagcgagcatttgatagatagatatttacgaatatgaacttaatgactactatttcaacgattttctacatatattaaaacaatgtgacgatgtctaatatgcgcgaacgtaaagaactaccaagtcttgaacgcatgagcattggatctggaaatgcacgaagagttgtccatctccttcgccggccggagcctgtcagcatgggaggcgcgcttcgctcagctgtggcaacggctcgccaccgaattggagcaccgggacgacggttcgatccgagtactacatcacttatgcacttcgagtttgagccctgttggaaacagtaattttaatagcaacatgatggcgcgtgcagtattacgctggtcatcaccgagaccctaatctcaccgtttcaggagtacgtgctgcacctgtgagccaattgatgagatggcaggggactcgcttttttctagcttaacctaattgatagaatgtgaacccaagaaccatttattcacttactgtagcaaggaggagggccttgatgattccatgaggccttacatcctcttggagacgagtaaattccttgggcaacgtgctcaagtgattgtacaaagcaggcgagaccgagactgaggagctaggtggacagcttcaaatgtactctgcaagggcacatgataaaagacgagacaagataccaaccacacgaaggtcacggccatgatgttacaacgggacaatggagacgagactcacggcgcatgacgaacacggcgatgactaagccaaccggagtccaatcgcgttagaggccgagtccaagtccaaccagccaagaccgggctggagcctggccagagcaacgtcagtgatgctctgccactgtcaatccgcactccaggctaagccccatgcgctctgctccccaccacagcgtcaccatctctctcgcccatgcatcgctcgcctttccgcaacccaaacgcagctccccagatcagacgcatacactgccgcggccgacttagctgggaccacggagctgtataatttccagaccgacctgcagaccgcgtcccgagacctgcctctgcccctcacgactaggcgcaacagcactgtcccgcagtgccgagcttagccaagagctcccgcctcccatcacctccaccatcaccatggcggtaatgtcggatcaggaccatttctccaatgtaacatggagcgaccatgtccaagagcagactgctagagcatctgccgacgaacaggatggcttagccgaagctcaaagcaccaccgctgaccaggatgttcaaaagttggttggagagagactcgagtgcaccgtcacctcgccaatcaaggagaatgacggaagcaaagatgccttcgtctcatatctgattactaccaatgtgagatcccactgaggaccaccggggacttatttgtctccatgaacctcaacccctcctcgctcagtaggcactgacatcacaccagtccaccttccaatccttccagaaagaccataccactgtccgccgccgattcacagacttcgtctttctttacaagcagctagtacgagactacccagccgccgccgtacctcccatccccgacaagcagcgaatggaatatgtccgcggcgaccgtttcggctcagacttcacatcccgccgcgcgaactcgctccagcgattcctcgtccgcctcagcctccaccccaccctccgacgagcgccgatcctgcataacttcctagagagcccggattggaacgccacaatgcgaagccggaatgcgcggggtagtagctcgagcgacactgccggcggcactgggggcgtgtttgacaacttcgcagacaccttcatcaatgccttcaccaaggtccacaagcccgacaggcggttccttgaggtcagggagaagagcgacaagctggacgaggatctggccaacattgaaaaggtggttgccagggtagcccgccgggaggcagatctcgagacggatcttcgagatcttgcagagcaattccagaagctcatcaccctcgagccgggcgtcgagcctgccgtccacggcttcgccgccagcgttgaggactcggccacccacctccgccgcctccgtgaggtcaccgaccaggactacctcggatcgctccgagacatgcaagcgtacagccagtcgctcaagcagctcctcaaggcccgcgaacagaaacagctcgaccacgagcagctcatcgagtacctcaacaagtcaaccatcgagcgagactccctccagggccacggcggctacggcggcgctgcatccggagccagcggcttcctaaggaacaagatcgaggacgtccgcggcgtggaccacgagcaggcccgccgcgagcgagcccgcaagctggagctccgcgtcgaggaactcacggccgaggtggagagggcgcgcgcgaccaccgacctcttcgacgaggaggtcgtccgcgaggtggccgactttgagcgcatcaagcgtgtcgagttcaagagccagctgggcggcctggcagacgcccacattgccttctacggcgaggccgcagaggtctgggagaggtatgccagggaaatggaggagcagatggccaccgcgcgagctcaatagaatcatccgaactgttgctgcctttcgttgattatcacgcgagatatattatggcgtatatatacatccttaccttaccttagcttgttggagtggcgttgacggcgtagtggttgtagagattcaaatattgaacaatattttcccactatttccctcttaaaacacttaaaaaaaaatcatgtcattaagatgaagaagatgtgcaagttttggaaaatcttttttgtcatttatgatgaaaagcaaaatatactggggaaaaaaaaaaagccgtctaccctttttgctatgctacccaactataagaatacatttaaccaatgtcatgtgggatttcaactccagtggtagaaaaaaaataaaagattcaatgaaaacggtgcgggggaaaaatgtatgcggaagaagaaagaagccatgtgcaggtgagaaaaaatgttacacggtcgtcgtcgctcccttttacggcgccggctgagcgggcttgggggtcttgggcttctcgttgtggctctcgtcgtcgtcgctgtcgtcttcgtcgccgcccagggcgaactggtccccgccgcgctcgccgggcaggcgctccgacgaggagccggcctgctggttctgggtgcggtcggtgtagcgctcgaagttgtcctcctcgtcgctctcgccggcgaaggcgtcgtagagctcgccgccgcgggtgcgacgggccttcctggctgcggcggccttctcggcgtcctcgtcgttgaggccgtcggtctcctcgtcgttgagcatctcgaactcgtagttgttgcgggagtcgctctgcaggcggcggcggcgggcgacgaagtaggcgccgaggccgcagcagaagacgaggatcaggccgatggcgccgtagatccagatctgggcggtcttcgaagcgccgaagttggggagccaggagatccaggaagagggcgatgtagtggcggactcgggtgtggcagaggtggtggatgtaggcttcgcgttatctgaacctggcttggtaggtcgctggatgtggtcggtaggaacagtcttgtgctcggtcgcagtagcaggaggaaggccggtggcagtggaaaccttggcggtctcaatgaccttgtcatggtcgtcatcgtcggtggcttcgggaagaggcagaagcttctgcttcttgccgtcaatggcctcaccccagagcttcaggtgccagtctacgaaatgaccggtgtcctcgttgacaatggagtcccggagaataagagtccacttgccaacaccagattcacccctaaatcaaaatcattagttttgcgaattataagtagacgcgggcagataactcaccagtgagcaacactcatgaaggtccagtccttgtagcctgcgcgagcctcatcacgctcacgagtgacagcgatgtggctgacaactccgtgagggctgatcaaatcgacgctcaaatcaccacggcgagtgtgctcaacgttcattgtgacagtgacatgctcaacgcgctcaaagttggcgtccttgagcatgtccttggtaacctcaaaagagacaaccagaccctcatcaccttggggaaggtcctgcttcacgtgctgccagggagagtaaaaccaggcctggggcttgacgagcttccagtccttggcgagggccacgatcttctcggcatcaagctttccatacgcaaaagtgtggctgaacttcttgccaatggccgtcgtctgaacctcgtactgctcgttatcgatggggtggattggctgcgcagcattcagggcaagatattgcatatctctccatgtcaagtcggggcgggtctgcagaacaagtgcgaacacgcccgcagcgagaggagcggcagcagatgtaccaccgtggtgattagtgcactgatcttcgccgacgtcggtggtgtgctgtaatgataacagttagcatttcgcgcaaatctgggggaaagccgacggcgggcaaggatttttgcaacatacaatatgagctccggcaccactgctgtaggcaacaatgagggtcgcagagcaaagctcagagtagtaggggtggtggccttcgcggtcaacagcaccgacagtgatactgtagatggagttggtgtaaccgtcgaagttgcagttgtcaccgtgtccggctccgtttccactggcaaagacgtagatggagcccttcttgtctcggccatcttggatagacttgaccattgccctcttgatgaggattgaaggagcctccatggtcttgccgtcgtccgaaggtccccaagagcaagagtaaatctcgttctcctggttctcgtacatgacagcctcggcctcgtcagcattagtgagcgggccactgagcatctgaagaccagcgattctagcctcgtaggcgacaccgagaccgcagacatcgtttcggccagcggaaatctcacccgcgcaacgagtaccatgcttatctctggtaccctggggccgggggtgaggctggtggcggttgaagtcccaggagccctttgcaaagtaattatctttcaaatctctgctgtccatatcgagaccgtcatcaatgaccgcaactgttacgttgtggccagtgatgccctgcttccagacaggggtcacattgatgtcgtggccgggctggacggtattgagcagatgccattggttccgaaatatagggtcggaaatgtgtaggtcgtggatgactgagtcttgcttcctgatggcctcttcgttctcttccagggggccggcgcgagtatccaagaatgggccctcgcgccgagggatgattcgcttctccaagtggccttcgcggcgcttctgcttctcggcgtagagaatgttgtctagcacatcgtcgacaccgccttgcgagcgcttcgccagcttccgcttcttcagatggtcgccgacgacgtcgtcttccgataggggcgcgcggaaaatgtgatggtcgtcgaggctcccgagggtgccacggtgttcaaggcccaggcgagtggcgacgacctcggggttgactccacggagctggaggacgtagaagtcgttggcgtcgtagtctcgcctctcgattgcggctgtggacagggcagtgaagcccgcgagggctaggatggaagaaaacctcatgatgggtgtagagaggtttggtcggggatgcaaaaagaccacatatgggtgcggcagcaggatggacacttaagtattcttctaggggttcctgggggtaagccagaggagcgtggctgagagtgcaggcggcctgtggctcgctggctgctaaagttgcagtgctgatctgtcagttagaggtacttccccacccattgcttttgaaacgatgggccctattgcctggctatcagtggcagcaggtacctacaggcctcgcgccgatgatcaaaaataggcacaagtctggcgcgtttccctggtacgcgatgctgacggcctgtcgccaaggttccttgccagagcacattgaccgcaacgctcggcatgagcccaattactttcgaatgccgtctgtatctcagtgaaatcatccattcatcaatctaggtttcagtttttttgtttttttttttgtttttttttccttcggtctggcgaagacttttatcgcatctactcccaccatctccaccgctgtcagcaaccaaggtacatacatggcagacctgtaattgatcgtcgtagtacatggagcaggcaacggcaccttcggtcccaatgtcccctcgcatcttgacgacttaggggggtcagtgtaccattgacaagcgatagcgctcgcgtacgtaatccgggcggatggtgatcattacctgtaggctcactcacctactgcatactacaggatcgtagaggtcttagggtcagctacgataccacctcctccaggctcatgcttccagacgtcgagctagtgaggcagaacggccgggtacttgttcccgctagatcctgactaagtggtgtccgtctccatgtcccaaaataaggcgagctgcacctcagctggctaagccgtaagatgcggtgggtcaaagtgcaacatgatgcctgttggttgagatgatggcatctaaacggccgctggttttattggcgggcagttcttaaatcaggatgtgcccatgcggaaggctactgctttcggccaagtctggagaaggccacgctgtacttggattctctttttcgctctctcctctgactgttttccatggcacagagagacattagtacagaggacaccccaagcctgcgagtgtgcgagatgtacccaacttcctggtccgggcagctcccttttggcaattacagccacattggaagcaacatcaaataggcactttgcatcgtactccgcaaaagataatatgcatgaacactcgctcgatgcacgaatagtcgcaaccatccaatgctggcgcccgaagtctcttctattttaagaactgcccaccacactgggagatcgatagcaatgtgtcctgattcagggatggctgcgagccccggtcagccagttcggtattactaaggaggatttccctcctgagctattattatccacgaaggattacaccagcaggctatgcgaaattgcaaagttcatgtgcaaacatcggggcatttattccattcattaaattactccctcccagagcctataggacactgtagattccagaatcctagaggccaagccaaatttcaagtctataggggaaaattggctgtcctgaagtgtgggccgctgactgctcctcctccactaaagtcttgcccatcagtgctcaaccttcctttcgcaggtgcctatcagggcagctactggggtacccgaccccctaacgttctccaatcccgctggcgtgcttctggctcagtgtcaaatggagttttcggtactcgaggccggcatatccatccgtccctctatcctaacatctctactatgatgattctttgtgtatctcgatgctcgcaggggcgcctgtcaacgccttgcactgggcgtatatcacgaactggccagacacaagcgcacatgtcatcacctaaaccgcttagcattcatcctcatcagctatagatggacatcgtgtcttaccaatcgtgggccgaggccagatgttaacagcttcttgggtccaaactcccgcgcaagctggaacatgcgactcgtcgctccctgtttcggatccccagcgcccttgttgatagccgagaggagcgtgtcggcaggatgcgacagcacagcggccgcggcacccgccgcgaggccggaggtgagctcaacccccgtagactcgagcttgctgagcttggcctttcgctccgggccaatggaccggaatatcacctcgttgacggcctcgtgcacggagaactggcccacggcgaagggcacctgcttgaacagcagggggacgaacccggagtagaaccccctcaggccctcctcgcgcgccatgcgggcgaatcccgtcgtcaggccgctggcgtacccgcgctgcgacacgagccggatcctcgtggcctcgagcgggcagagcaggatgtcggcgaagaactcggccgtggcgctggcccccaggtatatcgccgttcggcggtcgacggccttgtcgatcccgcccgccagcgagatgtactgcttcttgaagaactcgtagccggcgaacttggcgccgccctgggcgaggtaccccatcgcggttggcccgaagcccgtgagcagtgccgccgtgccttctttcgagacgatttggcgggctgcccggaccatgttgtagcctttcagggcatcgtcgacctgaatacgggtcttgacgacatcaattggtgtcgccgcctaaggataaaacgatcatagtcagtccccatatgagaagagccatacatgcaatgtcgaagcgcagaggacaaaaaacctacagcgtgcgttgaggttgccgcgagggcaccggctccaaagaacttgacataatcgctgaacacaaaggtgggaagctcgtttggcgccattctcgcgaaatccaaaacccgtctctgggtctaaaaatctaggtaagaggagtggacgtaggaaagcgaggtgtagatcagaggaactctgtcccgtcttttattttgcgccattccgtggccggcgcaaagatgccgcatgggagttgtgcgtcttgatcgatgacgtcgactccgtcgatgccgaaacccaatcaagcttgatagcgcatggcaattgctggtaagttatgaccgagcgcggcctactcaacactagcatctaggcactctcggcaccttatcaatatcattatctaagatacctgtaatagctaggaacatgcggcccggtttaggaatctcgtagctcgacaggcttcctttgtcaaaagttgatcgtcaaggggtatgaggtcatgttgagcataatcgccggtatcgccacaacgcaacgtgtgacttcacaaatacaggtctatagtaaaaggaaattgaaattcatatcctgagcatttggttttcggatccacgatgaaatgggcttttcttcttgccgggttgagaagatcgatcatggctatagggtagccacaacgggaggaagggtgaggtcgaacacttggatttcacatgaagtagccttatgtatgccttttcatttacgaattaggagcttatagcatttgagctagtttcattggaataatcgccatgagcctttgaaatttggattgtaggactggtaaggattgtatattgctaccaaacgagcctattgtacgtgagaggactaattacgcttccttatcatcctgcaagcaatccattgggcgaccctcatttgaaccccattcgatgggattgaatatctgcgctttgataccattcacacgatctttgatcgtgagtgactcctccatctccaggtacgtcagaatgcgtagtcgcgcatcctccacgatggctgcctccgaccccgggagcgaagccttggtctatggacatttatgtaatcgatatagagtagaagtgagatacccatcgaggcgcttgtacttgtgcgtaggggctcttgattgaagcgaggctgaacacacggcaaacgtcacggcacattgggtgtgaatactggcagtaaccaaaccaggccctgaagctaaattcgaggcgcctccattgcccttccggggcgataaattgtaagagcacgtgaaatggatggtgaagcatatataaccatatgccgagtcgcagctgagggaagatgtcacatggaatatatgcgtatcatctcatgccgcaacttggccggctagggagctcagaggtctcgatggcgggatgacaacgttaaagctgcggtgcatcgggcgttgcgttctgtaccttcgtcgccggcctggggcgagcctatctagatctctggaaatgagggagagccaagtaataatcccacagaccggtagaactcttggctggttctatgtgcactatttggtcgacgacaatgccgaatactctagaacccgccatgtttgtgaactacacacctggttgttgggccacgtttgagaaactcatttcccggtgcaactgcgagttgatatgaacgattaggttggaagaagaaacaccctagaagtgcctgacttaacgggaaacgataccagttttacgcaccctatcgttgatgaatacttgcttggcctgaaacggtatttttagctccagaaaccatacaaaaagaataatttggaaattatacttgaaggaagtacacaacacaataatctacagcaaggagataatgtatatggcgcacacatgtcctctggctcgaggcatatggcttttggtgttccaccgcagccagcttgccacccacgatactcttctgctatttatcgtattgaactaaaatatacgaagagttgattgtcgggtaatcaagtctggttctgtatacaacctacctaactatgacttgtttgcaaggcatccggggaactgggaaatggcttggcaatttcgcaacttttgaactgaattgatgaaaattatcgtaataatccttttacatacttcgaacgcacgcgtttccacaagatcaggtgggtaacgcagcatgctcaggcccatcccgcatgtgcagttggtcgatgcatagctggcgcctcagcgtctgcctacatctgattctatctcttccatcttttcatttatgtcacattctttacattcttcacgctccccattatatatatttcataatggatcagatttcaagagttcttattgccgttattagcttgatcctgagttttatataggtacctgacctcgctaggcggctttgccttgttaacgaatctctccactgctattctgaatcatttctgtactctgatatctctctacgacgggaccgcaactaccattcctttcctccgggccctctccaaagactagagttattcttatgtacagactgtttatctttgtttcgattagggtttgatagctttcaacgccctgctcctctgaatataagaagcatgccgcttgatcttttcattaatgtgcgattgaggagatcatagtgccttatgctaggtagcttgtgggttgatcaaaaggtcgggagcagccagcatggatgctcctttcagccttgcgatcgccaatctttcaagggtcagatttgtcgtaatcgcttggaacttttcctacagctcttcaattatttgtcaagttcttgagtgtaaagttcttgacggctccctgccgagacttgagcggctgaaccgtcggttgatctgttccagccaagggtatgattactttccatcaagcgaggatacttggcctcatagattatgtctattttaccttccgatggtgatagatctggtggtcaccacacgaaattaaacggtatttcaatggccggcaggggagcctgatcttgatcacccaagatcgcttgaggtggaatagctttatccaagctggctggcagaaattcttgccaaaacatggaacttgaaatcactggtctggaattgaaaatgcggttcttacgactcgattgaagatggtgatattatagattaaaaccatattatcgcggccttattacccctttaaagacatgctgaagagattccacgataaaattgatattaccgcctcagggtcatagagcggcctgcgcagctttggacgactgaactatcttaatgtgccgttgatatctcttgctggagtagagcacaccccacaagacctggaacaccttatcaaaggtaacgcttagacacgttgtttcacagccgtgttcctgtttagtgatttgtggtgaaatggatgaagtatctgctggggagccgcccggagaggagaaatgcggatttgactgcacgggatagggctatcacataagagcatgtcacaacaaccacccgggagctactcaaggactgtcttgcaagtttgccacgtttggatggcgtagctataggtgataagcacatgtttggagagacttggtaagaaaattctagttcccttatggcccaaacagacttcaactggaatcgtataaaagatcccctcactctttagccttgaatttccgttttctaatattatattccgatcgacgggtaatcaacaacatgcatgcgatttccgatatattctatggctaggtattttggatgagattaagagggcatagaatcactcattcccaatgctcatcaattaaaatacaatgtgtagtgctagcgtctaatctatcccccccccttttgggatggagccttccacttgtctctctacctgatactggcactattacttccattctctagtagtgattccattaagaacaggagggcaacgatcgttctctttaccttgaaaagagattcaataaaaggatatgaggagtttcgtttttacgttgggaagttccctaagtgagctgcggtttaatgcagtgtaggctttgtgaagtagccaatatcataaccctctcctgggatagaaagtatcaccgtgtaatacacgatataagagggaaaagcacaatttcttcttatttccctcctatagtttgcctatacctgacattccatataggagacgtcagtttgaagagccaaactccattggacaacattcctggaactgacttcatgcccttttctttgttcccatgtcgtctctgaaactcacagcggcgctattcatccattccggtttgggcccttgcaaaaatgggagctccggtaaggacaaggcttgacctgtctaagcggaagcctgcctggtattgacctgaccacctccaagctgtggtggttctactcgcctatcccgagtaggaggttagcaatggctcctaaaggcatatgaaaagggtttttttacttcccatatgtttcttacgactgactgactaggctcgtaaagatatgttgtctgcatttctttccgtcagcgtacccgctttttggaaggtttgatcagagtatctgatcgagcctgctttcgcccaggccccttacatgttgaactcgtcatccgccagcgttatgtataaaaactcaacgaaatccttgtggatagggatttactattgttctacgttaatttctgccctgtggtgcttgaaactttttagtaatccgctacgtaggtcttccttgtcgactgcgggtaaagcgaggattttgcagtagttgaggagttgagcggagagtactcaagttaggaacgaagtgtatgattgtccaaaacctgtaacaggagtcagtgtccgaaaaatatttacctagaaatccagtgtatatattttccttttgcatattgggttcgagctcctatttgtatttccccttgcacacaaccttgatattgatgactgattgaggtaataggcggagatgtctatgagcaacgctatttatctgggacaaattgagcaaggtcctacattgctgccgcgcaggtagtccagttcaggcaaagcagtataactgaaaattcttgagctacggatggtatgtagatcttaattgagcgtgatcgcaaggtctgcctcacttcgccaatagtgtgcaatgttgatctgacatagcatcaaactattagagtcgaagagaaatagaaagtctacgtaccaacagctagggtgaagacgtctttaggagtaggtgtatcacctatcgatctattaaccccctgtcgtttgaaatttaggagtgctagacaaacacggataataaaatctcgtaggttcaatgttaggttatctagggcatgtgagaaaagatcatacttggattttcttacctaggacctgctaaatatgaagtagacaagcaatctgacaggaacctctggacaaattcatccaagcgccagggatcaataacatagaaactctggataagtgtcagtgcccacggacatttagaaggtaagatacttacttactggagccaatgcttgataggcaagttcgaagcgaattcgattattcgtcaaagatgtgatctgcaagtgggtcctctgttaatggcaaaaggtatataccaaaaagggtaaaagcaggacctttctcagctgaagccaacagtcatagcttgcaaaagcacaccgagatctttagacccgctcgacgtacctgatgtcccaaccacattctctattgttttgagggaaggcaaggcagtgaagtttgaagtagagatggccagactgtcgctggttctcttggtttctttataaagaccgagtggatattgttgagccttggttggtgttcccttattactgctgtgtactcctctgctgttatccagatagattcattggagttaagtatcgggtagcatttcgccatcattacttcatgaagttcacaacctgacaactgacattttcctctacctaggtcggtatctatagataactaagagttaagaagagagataaagataaggtataatcagatcaactataactcttatagaataactagaaactattagttaagttaacattaaaagtaataaattgatattgaaagtattttaaataataaataaactattgaaattactatattttatcattatatataactttagtctaatatcattataaatctttctttagagggtactataacagtctatatatatgtatatcagcgcttacggttttacaactcgctcactgatcttgagggcatcgctctcgactctaaattcaggccaaacacagcgttgattggaacttaacaagtggtctcaatgcctatgcaatggcatgtactacccccttgaacgtgaactaatcggtacgtctaagacttttctatatctatgatagttcatcttgactctagttgactataatcgaaaaaacaatattggatctagccaaaagtaggttcatggcaaagtagatctggtggcctaaaatattgggttggcatcataattctgtagactaaggtgtgataatccaatttcaagttgaatgtgtcccaatgatccttctcagccaggcatgtttcgccaagaatgcattatgaataagcgggacatctggattatccatcccatcgaataaatggaaggctcctggccagacatgaagttcgcatgttgagccgcctccccacaagtctgttgcaaacttgactgcttgatcacggaacacctcacactcggctgcgtccacgtacgtgggaggaagattagaaagatctgttgcccgtgatggagactgatatggggttatgttggcactgccgcgctcgtctcccagcacacattcccacgccatgcggttcgtgactccacaccatgggatgctgtattcaaactgcttgtcagatatgctctcacagcgatcgtccagcatcggagagagtagcatctggcccttgatgggaatcttcgggatcttcctatcacgcgccatcaggcatgtggcagctgccaggcatccaccaccagatatcccccacacaacaatctctgactcgctgatgcccaaggtggaggcattctgagataaccagacaagtccagcatagcaatcctctgctggcccaggtgcccgagtctccggggcgagacggtattcaacggacactaccacgcattcgatgtctccaaggagctcaatcagctgggtgatgccgctgaagcgatcaccggccaccatcccacctccgtgtatatgataaaggcatgggagagcagagttcgtgggctcgacaggagaaaataccgataacaagagattgttgccgcttggtccatggatagaacgctcctcatgtttcagctgcggtgcactctggataaccgtgtccgcattgcagacaaacgcagctgcctcatcccccccacccgacacgcctctcataaacccgagatccagcttctcaggaagaggaaaggcatcgacaattgcaacaaggcttgcgtctatttttggacggggagtattgatcctaggatcaagctctgctgccttggagtacggaattggagttgtcgacatcgttgtatactgaattagattgtcaattacttatatgccgggaacaaggatagtaatcccgtttgctcattatttgaagaagagaagggtagaggatgattgtcacaacgcagagtaagcaggctgcgaactcttgggggctccacagccatgcagatatctgctcaaatcagctcgttccgagcgtgtcatcaaagcggtcagattctaaatcagtcagagagtgaagaaaaaatgtctgaaacagactaaatggactttcttatatttctcttcgtttcatcccagaatagtgcggtaaactttttgtttttgaagctgccaatggtctactcagatgaaaaagtcgtccgttattggcaagtataatattaggtacaggatacacgaggccttagaaatggttttaattcctggaaacacagttgagagtgatccaaatggttgaagtaaatgggttgttgagctaaaatataaaattaggctgatttaaatcgacgttactcttgggacaatctgtgtgcggccatgaattctcccctcgggccaaattggtcattcgcgcgacaaattggaaaattatccttttcctcgcttttgaaatatttaatagggttcttgatacttaagccttcagatacgagacggatgtctatatgtgtactcaacggctttcagccctagggcttatcaactcaacattgacttcataaactgagattagattttcccctcctgaaaggatctccttcgagggatggcttatcggaactgtgttctgaccaagatgtgcctagtcgtcctacccgcagcctccaccgagcaccacgggattcaacagcgtgtcggctctaataagtcccaggactagttgtaaatgagtttaagaagtataggaaacgacctagagagagaactatcaaaatagtcgtcgttagtgatatatcaggataagatgttcatgaagagcttcgtgttctgtcctaccaggcagctatgctggtaagaatgaagataaattggataatttagtatctataataaaagcgatacaatgatttaggtctatctgggattaaattaatagcgtgctgaggctagaaatatatataagctagagtataggtgttatcactagttattgaggtctagctgcaatggttgaggaaaagtcaaggccttttgaaggtgaaaacgagaatgtagcggcgagtaagctttatgtttaattctaaaagcagatggagatgattggctgttactcatttttattttccacaataaattatattcataggaaggaagaagccttgagcatcggagaaggaaagcaacaaattgttcaatgtcatgtatacctagatagtcgggaaaactgaatccagtgacggggacatgaacggacttcaatatcagggttgatgttaatcaaaggtgtaggccggcggatgagttacaatggcgaaaataagactgataattatccatgtaatagttatgtaagactaattgttgggaagatattctaggactccttaattactgtgactagaaagaatctctagaatttcaggatctgtcgcttcttgaatccggttaattaacagactttggaagtagctacccatcagcttaggcattactagtaaatccaagtatagtacttgagtaagataagcctacattttatgcattgcatgcacaagctgtcagccaggtaacagttcacgagtcacaggacggtcaaatttgtgggctaagtcttacaacagaacaagcacagccacgcgtcctgaaaccctcagagaaggagatgtcagaccagaaagcttccaaaagttccgtgttgcacacccacaaaccacgtgtcacatcaatgcctccgtaagataagatgcatgaaaaaggattgcgtatgccaatgtattcgacaactcatagcgtgtggcactgggttactctgactaagaatggctttgcctcagctaagcaacctttcattgaggacacaaatggaagcacagacaaagatcctgatgatgatatcatcttggagtatcctaaaggactatacatatgaattcatcataggattggcttcgcataaatcactagacgtacgcctcaagctcggtggcaacgccgcggatgaggcgttccacaagatcatcctcgacaacgccctgctgccaactgaaaccgatggtcatccccccatcaccgccggtgacgacactcattgtaaccgcacaccctgagacaacggtgctgcggctaaaggtcacgcggcctacttcccacgatccgagggtgtagccggcatcagccttccgagagccggagaagatccccaggtttgagacttcgtaggcagccgcgcggtcagagccaatcaaggactggaacacgacggagaggtctggaatattcctgaatatggcaacctccgtgtaaggttcccccgaaggcgaaagattgccgtgggcgtaatgatgtatgccctgtgataccctcgtagccacgtgccatgtctgtggactctcggcacccaggtcgtcacgtgtgagctggaccttgaaggcatcgatgtacgtcccgattgcgtcgttagcagtgtcacctgggagcttgagccagggtcgcaagctgacaggaataaggcacttgatcgcttcgatgtctggtggaaggatactgaagaggacgacaccaatcgtcgaggagacagaagcggttatggacacccctctcttcttggattcctcgctgaaaatcttggtgtggtgtggtgagacgtaaagtgacctgtaattggtgtggcatggaggagggagaacttgagcccccgtccattctttcagcgctgcattgactggaggaggagcagggttttcgtttattggtaaaggatgcaaatcctcgagaggaggaaggagagacccagtgttggaatcaatgtattgtttaggtggtaaatcgaaagcttttccctggaaggtatccaatgcggcttgaaatgctctgtgaaagacgataccggagagtccatcaccaatggcatggtggaagatgaacgaggcagtaaactcggtctccttgccgggtggtttcagtacgagcaaacgccagaaaggcaaagttccgtactcggacttgaaagaggtattgtgccagctctgcaataaggagtcgagttctttgtcttctctttcctttgcctcattcagaggagcttcccgttccaagatctgaacagcacgatcaaggttgactgatggaagtgaggcgaagtatgattcgggagtcccctcatcaactggaatcgcagaaagaatgcggtgatcgcggattacattggctaatgctctatagatgagatctcgaaggctggacacggagcctccagagagcttgtagtgggcagaaacaccaacattgttgtagaagccgagatggtggcaggttgccgaaacttgctcgagcttgcctatggattgaaaactatcagtaatgagttttgatttaaactgggctgagagtttctattaccgaggggccgcagctttggaagggcgtgaacgtctgccataactcaatattgcctctaatggacgcaatggatgttcatcctgtcgcagagtaggacctttttgtatctatccataatggacagggtggacctcgtcatgtattataccatccatgctgaactcgtggggtgctcttgctccatcgtaactcatgatccatccgaacatctccggaaggagaagagcagcccatttccagtcagcagaaaggatctggattggcacgttgacgacgccgtttcttggcatttgatctaacggcttggaaaataggcgcttttgtaatacgggaaacgtgggtattgcgcagaatagagcacatttgcttagtctgcccaccccccaacaccagctggtcctgggatcgtggacctagtccgcctctaatgtacaagcatgactgcatatgcaatcctacgaagcacagacccctgcttgctgacccatgttgttatctttctttctttctccttagctgagctcagctgtctctacttcgcacaccctctgataatagcagcttgacaatgataataagaagtgcataattgatagttgaattattaggtaaacttccatacgcttgatacagtgacagcgctggttgagcagcgcgtgaacaaatctgcaaaacatcccaaggctcagatcttggcccggccttcctactctcgagacattgaagagctcccagcgcttgtgggtgagcttgcggacttctttttctctgcggtctgttgctctgccttgctaaccggctccttcctgcccttgggtactctggcaagccagtaaaacccaattgctgctgcaatgttgaagacaatatagactaagaagatgccaaagttcctccatctatcattataatctgagctcacagacttcaagaatatgttggtctcgctgccagaacaaaaaatgcattcagtggtagaatttgcgctctcaggcacgagataaccgccattgtcttgcatgtaagctgcgaggtactcagagcaggttgatgacgacgggggggagaagcgcaaaagttcttctgaggagcacttgatccgcgcatttgcgagtccagttgagagaatgccagatactagataagtaaacggtgagactctgtacataaaaatccaaaaccctggaagagcttcaggcgttgctagaacactaaaaacatgcattagtggttgcgacattacggctcgcaggaaggagaacttacccgcaaaaaaccagggagaacgagaatagaagattgataatggcaccggctccgtcttctgtctcgataccagcaatagccatgtgtgtgaaggtgcccgcgaagacgatgaattccaagatatagaggaacattaggcctcctcgctcggctacctgccctgactctgaggcattgtgttgcaatccaatggggtaataccagctaaagaagatgagaacggaaacgagcgagttccatgagagctcaacgacgatattcgagagaataaacaccttccaagagtatgttttggattgtctctcgcgtgcctcgtagattgcacgctgtgtcacaaaatggggcatgatctgagtacaaaagtttacgaagattgtcagcagcatgaataccgcatacatctggttttggagcccctgaagcgtgtttggggttttccagaacgaaaagccgatgaacagggcctacaatgtttagcataagctcataagttttgtttacaaggaaaaaaacttacactgaagaggcaaagagcaaccttggagtatagatatgaaggggtgcgccaatattgttgataggctcggacaagaacggccttgagctgaacattgaagggattggcgaatggatcaagttcgctgctattgatggacactggctgctgcgctccagtttctctcatgatggcaagtttggccttgatcgcttgccgctcatccgagtttctccaggcacttggccaatccttcggggattctgcttctggggccgccgtagtaacttcaagtatccactcagctggattttcgtccgcatggcattttcgagctccgttgcgttcgaagtagtttatcaaggtctttgatgactcgccgatctctccaaagtaaagtgtattgccacccatagcaagaaagagaaggttatcgaattcctggaatagaatagccgagggttgatggagtgtacaaagaatggcctgcccgttgttggcaagctttcttagcaaggtacaaatcgaccaagcagtttgactatccagacctatagaacgtttagaatgcgggatcttgaaatgatcttctttacttatctcaagaaaacaatcgcgcaggaagggggaaattaatactaaccggaagttggctcgtcaagaaagagtaacaatgtaggctttgcagcgagctcaaccgcgatagtgagtcgctttctttgttcgacatttagaccttgacgagtgttagcaagaaagaattatcttatgacggtttcaagggaacagaccttctcctggtactccaataacagcatctgcatacgtctccatctcgagaagcttcagaacttcatccacataggcgattttttcggcctttggggttgagtttggttggcggagaagggcactgaatgtcaacgcctcccgaacagtggaagtgggaagatgcaaatcttgctgctgtacgtaaccagtttttctcttaaattgcaaaagtagttagtttcatcacttggaaactatatcaacagaatgtcttacttgaaatcccccatttctgaggtggccgtctactaagatctcgccattgacaacgcccattgtgacgcggttagcaaggacatcaagaagtgtggttttcccagcacccgtcactccctacattcggttagtaactatactcaagatagacaacgaaatcgggcttaccattaatgcagtcagtgttcctggttttacccacccgtcaacctcattaagaagctggcggtcttccttgttgactttgatagtgtaggatactccgtcccaatggaacgctgccgtttgccgttgaatgccgctgggaagaacaatacccttctcttgatttatgatttgtgagtcgagtctatcatcactcttgccttcctcatcatatttgctctgaagtttaggcatgtgctctcgtttgaaaagcaacacttcccctttggacttctcggctagaatatactccgaggccactaggtagcagacacagccaaataccatcagcgccagaatgatgccaaaatttctacgtgcatttgttaatctatttctcggggaattgggagagattcacgcggcgcatacctccacaggtggtcagcgctgtagttgaagttgacggctaaataggtgtctccatccacaaagtttgcccctgctaaacttccggttgtggtgcagatcctctggtccggggaagcatccggataatcaggaatataccgggtgcaaggaattttgcggttgtggaactaggcgaggttagagttggaatagataagagttggtctttctagtatacctcgttgatcattagggattcaaatacatatccaactggattgagatagttgagccagcgaaaccagggatgcatatcgttgacagggatcgtgaaaccggtatagatgacgagtgccagactgaaaatggaagccggagccatagcctaaatagacagtcagcaccttattagaaccagagggttgaccgaccatttctgacctgaggaaatgtacgggacagtgccgcgatgcagcgaaagtacatggacattgttagcgtgcaagaaaagctaaatagcaagaagataaagaaatggccaggggtgcgccgcaggttggtcatgaagtataaggcaagattgaacccgatagaagtaccaatcttgttcggcaaatcgcaaatcatcgatgctagtaacgttagttagacttagttggaatctctttgggtatgttgactgacagattgcttcagtgaagggatggtaaaaggcgtattttgattgtttctcgacaatcggacgttgggcgtatagggtcaaaatctgttcacgttagtcatctggcacttgtctgaatggacagcagctgcggacctctaaggcgctcgcaaaagcggccaacaagacggcgaagaagatcaaagcccctttgctatatagagtagccgtgttgtttggtaggttataaaacacgctgccaataactaatgctagaatggcattgaatatgatactagtgattgtgacgtccatggcacttaaaagtctttggtaacctcttcccatgcatagcttgacctgcattggcaccgagagagtgtatggtgactgtgcacgcctatcgttggttagaacacggtagataagcgagactgggggaacagggttgaatatgtactgtgatcttgcttgtgaagcttttcgagactctctgaatttagtaagcgaggggccactgataggatattgcgcgttgaaggcatcaatttgctcgagtaaaagagctcgatcttgacttttctgccatatcgcagcaaattcatccggtgttctaggagtagtgctctcaaagcccggacggattagtcgttctgctggattggttagagaagtgaggaaatctcctgttgtttgtcgtggtcgacattcaaagcccatgtcaatgaagaagcccttagctgcgtcgatatcgccgaagtatatctggcgaccttcatatagaaccgcaactttgtcaaagaccttggtaaccttagaatagcaacaccaaagatggggagaaaggatacaaacattgtatattgactgagaagtctgaaagagtgtgacgatagcggtggccccggttagttctgtagatgttctcaaagttcttacaaactcgagggcagtggcgctatcgagacctcttgtcgagttgtcccagcattgaagaggacttccagcgattgcacttgaacggactagtcagcaggatacttggatacatgttttcgttcggtagagataacgtacgcttctgcaatgctaacccgctttctttcgccgccagagactcctcgaaccatgtcattaccaacctgggtttatcgtcagaaggtaaaaagtgaagtgcaaggattaaacgcggaacgcaccatcgtgttcatagtatgactaagaccaaaaattgccataacgacatctctgacatggctggcatacatctggaaacatggttagagcaaggggctgcttggagtcggaaccaaatcggcttagctaaacttacatctcgagtcacgccaggtaagcgattgcgaggagcctaattgaatctgttagctaccacagttctatagcatataggtaataatttcgtcatacccgggcgcgagcagcaaagtccaaagtctgacctacggtcagttgagggaaatgaacatcgacttctgcctggtagatagactctcctcggaagtccttgtgcatgatctccttggggatgccctggtaattgagatcagagtctgcaccaacaaaaaacccttcagtctcgccagatatggttttcaacagcgtagaacaaccgctgctcttgttagaactcacggggcttcatagtgtcttggggtcaatgacttgccttcctggccgtccgaggacaagaagcatctcgccactcttgataagaccgtccatgtccctcaggatctgaattcttctcttttgagaggaagatcccaaaagccgtttgcaaaatcccagcacttcaagaggataattaccaaaggtcttttggtaatcggttggctcgccaaatccatgagctgctagatttttatacgcaacaccggctgttctagttggataacgctcaggatcccgcgaggtaatactcagtatggttttgagccatgttcttgcgctgaaacttggagaatttgggtccagcaaagggttatcggaccccaagaaggggttggcgggctccccatgttcattcttgacactatggcaggatagcttcctggctagacgggcaactgtctcttctgccattggaaaaaaaatctggacggcaagaaaataacagcaacgagaaggggaaagcttgaaagcctgaagaaaattcaatgatggatcgatgatgtgaagcaataaactaaacggagcaagccgagggcagggatgagggcgagaggggtgcaagattctccctcctactccagctgcatgtatcaatatgtcgggcacacacggcacgtccaccttgggatcagcaacgagggaatggatcaatttttggaatagaattctgcattgtagtggcggcctctcgcccttctaagcttatcagatgcgcaagtttaaggtagcttcagccggcccagtccatcatgcagcacgcacgcccccccttgcgcgtcaaaaaggcaattaattacacgactgaggcgattgtgtatcggtcgccggccgtacctatcacatgctgttataccacaggcgcaggtcgtgccggaaccggtatcctggccgcatcgctgccctgcaggcgggctgatgcttgtctaagctgagatgcatgccgctgagcatgatccttcgtgtatgtacgcgttcttctcaccgtttggtcggtaccctgtggctgcattgtgtatgccaaccaccgcacgatgctgcagcccaagtctcggctggctcgggttcacactttgtgtggtagtaatgatcacactatactaataatgtcttaaaacatgccgtcatcctggcgagggccacatcatcctctgtgtgctatgtagggctatgttgaggagtgtccaacaacaaacagcaacaaggcttggagatatggctgagcttgagaccacaccatcccccactcccccacacggaaggatccctcagcagaaaaatttaatctgactcaaacctgctccaatcctaggcagaaatatggacgggttttttttgtcatcaacctaaaaaaacgggtcgtacacgcttacacgcacccccctgggcgtggtgattgctgccactacaggaacagccgtcgcagacggcgcgtttgccttgccccaaagctaggtagaacaaggtctatctttggaataccatgcgggaattaagcaagtagtttggcttggtcatacggtgcgtccgtcaggaccgtgccggggagttggccttggacccgtttaaggtgaggtcaggccgtcatgccatggcgggatggctttggacggatgtgagagcaaacaaataccgtggagattccaccgttgatagcaagcttccggcgtcgattgctcatctccagacgggtagtaacatccatttcttccttgccttgctcgagatgcccatcattatatattgaagccccttgcccacaatcttaatctcaacatcccaacaacccccctccctcactctagttcgccatggggaaatctaccgttgatcagacagcggtcaacggggtgcatgttgacaaaggcgccaacaccaccgctcaattggtcctcaacatcttcttcgaatatgccctcaataagtttgatgactcccaggagcggatggctgaaggagcggccaaattcttgtcagtcattgacaggtttgttctcgctggcaagacaattgaggcctgcctcccggccttcccattcaagtctgcgaacaaggtatacaaggtcttaggtagcctacctgacaaggccgaggagctcgctcttgagcggctgaataccatatgcaaaagaatcagggagatataccctcctggcgcgaagataaccatcatctctgacggaatcacttataacggtattttcccaacactgaacaggcatatcttcctcgctaataccttcatcaagatttgctatccatctctgaccgcgaaacatgggcctacggagaggccttgcgcgagatggcggtcgagaaaggcttcacctatatcgaatttgccagaatgaagcatcttcttgacttccccatcccggacgaggaacttcgcgagatcacctatgttgctaattgtaccaactttcggcgattgctcattaacacatatggcaaggacgaccttgatattgatcaagagatcgccaataaccccgatactcgcctcacctaccttggctatcggcggtttctcgagtcagacctcaagtacatcttcccacccactaaagataggaccaagaatggctaccggagagatgtaaaatttctggccaagcaaatgctgatgcgtggatatgtaagtattgccccctttgttctctttcaatttccaaactggcgtcttgtttctaatcaattacccgtgtacaggcatttgcgggggcaatccaggtcgcattccctaatcacttacgactctcaatccatgagtcctttggtgcgagcaaggtatcaatcagtcttctcaacacaaaaactggcttcacaacgccctggcactgtagtgtcgccctcctagccaacggagaatgggtcagtgcgcctatgagcgagttcaagagagagcccaggctggagttggtctacgagaatgaccgaccgagctatttcaaagaaaaggccgcaggtgaaaatggtcttaccattaccgagttgtcagcaagcttccttcgggtcccgaagcgcagcagtggggagtatagcgggttctcttctggagtcagcgacacatcgatgcagagtggacggtcctcacctgtcaatggcagtgcaaccagcgttggttctgggagtgacatctcttccaagatatccaagaaatctaagaggtcttctttgaggtcttctaaaaactctaacgacttcctcccctacgggaagagactcattccccagatcatggatgacctagccgacaccgagccattgcgaaccgtgttctcgctcgcaaccctctccgaaaaatccatccaactgagatatatctctgcgcgggagttcaccaatgcagtaaacaagactgcttggtggattcataaccaagtgggaaaacctgactcaatccagcctattggttatattggacctcgtaagccagagacgatcttcccttgtcgtcatcttgcttgctaatacacactagatgatttgcgccacgttctactaacccacgcatgttccaaggctggttatgcagtaagtcgactcataataagtctggtgtatattggttcatgctgatgaaaggtcaattctgcagactctgtttctctcccctaagaacaccttggagggtacattagcagtgctcgaagctacctcttgcaacatctgggtaaagccaggggagttggccactatccctctagttaaggatgttctagagagacgccctatgaaggttctcgaacttcctttactagacgatcttcttaatgccgactccactcctcctttcccgttcacaaagacatttgaagaggccgtcaatgagcccttctgtttcttacatacttcagggtcaactggtcaccccaagcccattccttggagtcatgggttgattggcactatggatgctatacaaatcctcccaccgactgaaggagacgacggtctgttgccatggactgctgattggaagaaaggggatagaatttattcttcatttcccatgagtcacgtatgtatttcgtttgttacctggggctttaattccgttgactaattttcacattttatcagggtgctggtgtaattatggacatactattgcctgccctccttaacttgcactgtgtcttggggcccgtgggtgttctgccaaatatgaatctgatcgagtccctcgcggagcaagccaagattaatatttggagcatggtgccctcgcttgttgacgagctgggcgagacgcccgatgtcctggcgaaattcaaatcttcgaaattcatttgcgcatctggtggtaagtgtcttccccaacttatgttctcttcctgctctgtgactcacttgtcatcttttacccaggcccagtcagtcccattagcgcaggaaaagtgaacgaggtgatccgggtccttaacttgacaggcaccacagaaggactctttattggcaaccttgtggtgccaagagaggactggtggtggttctcctttcatccatactctggcttcgagttcaaggaggtcgagccggggacttacgagcactgggtccaccgtaacgaacattggcctctgttccagggcatatttcatacgttcccagataaggactccattaacctcaaggatctgtacaaaagacaccccacaaagcctaatctttgggctttcaagggaagaagtgacgatctcgtcgttttgtccaatggctacaagatctcacctctggagactgaagcgttcatcagcacgcaccccgccattgatggctgtctagtcgtaagtcggacttttatatgttgatacatcaccacgccgaagagtaaatgctgacctaatgaaacggcgtagattggaactgggaggcctcaagcggcccttctcatcgagctgaaggacccctcatctaagactgatgagaagctactggacagtatctgggagacagtccagaaagcaaactcgcagtctcggcacaagaaccaactactcagggacttcattacctttgcggaagccgataaacccttcatccgaaccgacaagagaaccgtgaagcgacccgcaacgctggcgctgtatgccgatttcatcgagagattttacagctctcgaagtgacgatttacctgctaccgccatggatacaagctccgttgaatcaatccagcgttcattccgcagtgttcttgagcacacactgcctggtatccaggaagctcccgccgacgctgatttgtttgagctggggctcgactcactgggcgtgtttgcagccgtgaaaacaattcgtgccgccacaggtttgaaagacaagttctccactcggtatatatactcaaatcccacgatttccagcgtatctaccgtcatacatggactagtggaggaaatggaggcggagaagaagagtagcgctgctcccaccacgaatgtagtttcgaccaacctcaataacttgattgcccagcacaaggccaggcaatccttccgattgaactcactggattacgtcaatccaaaccattacatgggcctcatgttttattttcccctgcaagaaggcgccagctacgaacaggttttcgagaatcttcaagaaggcctcaaccgcactctggagctcatccctgcattaggcgggaaaatgatgaactactctgagcaagagttcgggtacaacaataagggtgaccttggagtaacaattcctccgctgtccaaggcagcatcggtccgcaatcgcctagtgtacaaggatctgtccgacgtcctgcctgcctttgagaaactgcgagaagatggatttgtcccttctgcgcacagggataatcaggtgctgcccgatgaccctttccccaagttccccgcgaatattctggttgctcaggccaactttgtcaaaggcggctgtatcctggccgttgatatgaatcattgctgtttggatggaatgggcgttatgatcgctctgaaagcctgggctgagaattgtagatacctacaaggtgatcactcagcaacatgtgattggtatgatgctgaaagcttcaaccatagcttgccagagattatccatgagcaagagggctggtcccgtcctatcgaggagatagatccgggcacctggggctatttgccattcttccctcccgagggcaccttggaggcatatacccccaaagaaggcggtcttcctcgcccgccagtcttccctctgcattctgtgtggcctctgccccgcgccgagagagtgacgacgacaaccttgttcaaaatatctccggagaatgtgcagaagctgaaagataaagttctcgccgacccggaggccaagggagccattacgtctattagtgacatcgtacaggccttcttgtggcgctctgccattagggtgcggtatcgtgtggcaaaggagcagaaggggaggacgttcagctcggaagagatgtccatccttgaattacccaccgatggccggccctacttttcatctctcttgcctgaaacgtacatgggcagcttgcttatacttaatcggtcgagcatgcccatcgaaacactctgcgcgccagagacgactattgggcagattgcatatctacttcgcactgccgccgcgagaatcacgccgtcgctcgtccacgacgcctttaccattctgcaatcattgacggaccacagcaggttctcaacggccaacatgggcgtcgaccatttccacgccatgatctccaacatgatcctgttccagaccagcgaggtcaactttggagacaagttctttggtaacaacggatccccggagcagatgcggcctcagctggagcgtggaaacggtcgcttccggttcttgatcatccctcctatgctgaaggacgggggcgtggaattgctatttgggacctacccggaggagctggagattttgaggacagacgaggaattcgtcaagtatgcagagtttgtggatgcatgattagcacgacggtgtccgttttgacttcatctatgtatttgatactcctatgaactccttcttttagaacagcgatggttagtagtaatctttcagcatctcctctcaagatcacttgttgcaacaccaaccgcaaagctagcttccaaagtagatgtcacgcaacttgagcccgtacacactgcattctatgcacgatgcacctcatggtccgtaagaagccaggcatcgtcagctgggaaacatggcttggcctagcccatctaaggtttgtagaagatggtctgccaaagagcgcaaaagttcgctctgctctgcaagactaatgcatgttgatatgatgacccttgatgatccacttgcgccccatgaaggagcccggtccgctcgtatatatagatacaccctgtcagagaaacttgctcactgcaaatctcgtggcggcaccaaccaaccgctcgcatgtagatgtggtgcttccaagatctctgttcccacccgccccggccacctgctggggttcgttctaggttcttcttctgaaggcttctctgccttcgtttgtgcgtacaaagctcctcacgggaaagtttgctgttgcatatagtggcttggaaatcctgcgccgaggattacctctcgtcagcatcgccgatcgcacgcaagtaccagcagagacaatacataggtatgcgtctatcagcgcgatagatgttcgccagtgccaaaggagcgtctccaaacaacgtggcaagggcatcaccgggccctgctggtgggcttcccgtatatacacaccccctccaccggcagagatctcgtgaacaatcatcgaaaggcactagactggccatttccttgttcgctttacgccgaggcggctgcagggcggaagagcagcctacgctgagacaggaagctatcctgagacaagggtctctggcggatgagcaagttttctcagttgcgcttcaagttgtaccagctcattgatcaatggttttattgattgcaggaaaattaacatttgccattcagctccagcatcagccacttgtgtcactgttttggctcatgttgatcccgccgcaactaagttcacctgctcccaacctccttcctccttcctcagccttcactctttccccctccaccaaccttcacctcctccccgacagagagagagagagagacatcaattcgccatggtgagctatagcgacgagcctcgcgtcgaggacagcaaattcgctcaccaccagatcaatggtgtcgaagagcgcggcagttcgtccgaccccagcgatgactctgcaccagatgccgatacgcaagtcggtattcagaacatccaggccacgactctggcttggacgacgcggtccctcgttttcgccttcgtcatgatctggctgacgtacttcgtcgagggcatgctgtccgcttctctcgtggctttgacgccatacgtgacctccaacttcgcattgcactcgcttacgcccaccgtgtctattctaagcagcgttatcggaggtgtcacaaatctcacgctcgccaagatactcgatgtcttcggccgcccccagggatacctgttctgtgtcgtgctcgcgacggtcgggctcattatgatggccgcgtgcaacaacgtcgaatcctacgccgccgcccaagtgtttcagactgtcggcaacaacggaatccagtacagtcttaccgtactcatcgccgacacctctaccctgcggaatcgaggtctggtgcagtccattgccagctcccccaacttgattactggatggcttgcagggcccatcgcttccggcttcctcgccctagggcctgaaggctggcgctgggcgtttggcatgttcacaatcatggtcccggcaattactctccctctatctggcctgttcctcaagaactacttcaaagcaaagaagctcggccttgtccagagccaggaaaatcatggcaacgccctccagagcttcgtctactactgtcgccagttcgatgccgttggccttgtcctcatctcggctggcgtcgccctgtttctacttccttttaatctatatactctccaggcgcgaggctggaactcgccccttgtcatcagcatgctggttgtcggcatcgttctcatcattgcctttgttatctgggagaagttcttcgctcccgtcaccttcattccttactcccttcttcttgatcgcaccgtctttggcgcttgcatcctctccgctatactcttccttagctatatgctgtggaatagctattttacctcatatctgcaggttgtcaaaaacttgagcgtcgagaatacgggctacgtcgtccaggtttataccgttgtgtccgtattgtgtgcaattggcactggtgctctcattcaccatagcggacgtttcaaacccatctgtctctatgttgccattcctttaagcgttttcgggctgggcttgatgatccacttccgcaaccgtggagatgttggatatatcatcatgtgccagattttcatctccatcgccgctggtatcgtcatcatcaccgacgagattgctgtcctggccgctgcgtcgcaccaacatgtggcggtttgcttagctgttgtgggcatgtttggaaatgtcggtggcgccataggtctcacggtcgcttctgccatctggcagcatgtcatgcccgagaagcttatgagctacctccctgttgaggatctggagaacctgccaatgatctatgctgatctcaccacccagttaagctacccagtgggatcaccaactcgcatcgccatccaaaatgcgtatgcagacactcagacggttcttctatctaccggaactggcatctgggtcatcggtcttattggtgtcctcatgtggcgtgacatcaatgtcaagagtgtgaagcaacaggccaaaggtcatgtttggtagatcgctccggggaaacaccaagagtgttagatatcgcctccacaacgcgactacaatggacgtgatttgatttgggatgggaatttgttttcagcagttggcggggggctagagaaaaatacaattagctatagagatggacacgcaaaataatacaatccccctcaaggctcaataatcttcttggacatgagtgcccatacaaccactctcccaaaccatgcttacagctcaccgaagcttggctcgtccagccaaagcagtgatcgcaggcatctttcgaatccattcctgctttccatactccgcagcatcgacaagccacctcgccagcgccgccctcctctgttgaggagaccaccccggcgccccaatagtgccctcatacgtctcatgatcctctctatccgcccgccaagattcctcatcgctaccaccaggaatgccaccaatacgatacacagtccaatccaaccccccagcgtgctcctcaaagacgcgcgcaatcgcccgcgcggtccgccatccggaatgcgccacgacaaacaccaaagccacaatgagccatctgatgagggagaagtggtcaccaggctgccacaccgagatggtgctcatggcaaagatgcggcgaacctgatgctcgcgcatgagtccgaacagcagcacgtagaaattatagtatactgacggatccgtgttcaggagactgtttgggcccaggagagacagaactgctgagcttcgcgaaacggcgtcggcgagttgctcgccgtcagtcagctcgcctttgactacctgcgcgcgcctcctgttagcttaggggtgagggtaacttgcaagatctgcagcggtacctccagctttgaattcgacttgagatcatcgggtattttggaaggattccttgcgaatgctatcacgtcatggtcgcggaagaggagctcgcgtaggaggcagatgcccgcggggcctgtaccgcctagcacgaggatcttgcctggcatggtgctctttattcatcgaggtaatgaagtgacaggcaaatgtttcgctcttcgtcagttgggatacttgaaatatatgtcgagtaacagaaccccgctgggcaatgcggagtttgctcgtaaatctcgtactggtgcgcaatactccgtactgcatggggagatgaccttaccatggtgccctccgacggttggttaccaatattaggccacacaggcggagtttgacgcaatacattagcatgcaaaggaaaatttgcagtgcgatcttaggggaggtgtccccaattatttgagtgaatccatatcatttggtcgtggaagagggaaatattgcaacaattaaccataactcatgggcgcatccaagcctgaggcgctggagctcagtgttccgggaacatttgatggtgatttagacgccgtgagctcgttggcaagaagtgtgctgggtttgtgaatggtcactttccctaagaggagggaccgagttgtgcaactgtggccaatatatggcttccttataccacatccatgaatgttattatacaatgttcttgtggttaaatatacggcaatcccaccgtgaaaattttgtctaagaatagtcactacaagaagtggaaagatactccatgatccttttaccacaacccaatcggaaacataaatgagataggaattgctgattattactagactgtcaaattcagtatccagcactgagttcatcttccagtactttgaatatatgagaggatctgcccctcaatatctccacaccttctttgtcaaaggggatttgtgtgtgccaaacgaagctcgcatccgtatatcctccatattatatgaagcatacagtgctatctctgaagaagggtatagatggagctttaaccacacgaagtctcagttgatattaaaaattgagcatttgttcagaaattcttttaacagaataaatcagtagcctcataaacaagcgaatcgatattcggcagcctaatctactagatatagtagatatgataaacccccagacggtgagtccttctataatattatgaacgatgtttggaaatccagaaaaacggaggcaactgtgccccagatgaactcagatagtcaatgttcagtccctacaccaacttagagagcctaataaaatttctttaccaaaacctcaaggtgcttgtgtaagttcagtttttataatgctatgtaaccttgaattctttccttgatttttagaaaagagagccaaaattcatcaagggagggttaagaaagcaggctccaaacaccaccaagaaatattctagctcaaatttggatttaaaaactgacggcaatttggataaaggttgaatatggctctccgtaagttaaaacggaatcaacataagagacagttatggcatcccttctaacacatcaagtgccttacgatgtttaaaatcttaacacaacaccacttttacagcgtagtatagatgaaccatatataattactttctatgtacagtcgcaagagagggtcaacttcactatctgcctagaagtggcttctcgctgaggatagagtgatgggtatagggtaggcagctcttctaggccctacgagcgagtcctcgccatctcaaacctgcaggaatcacccttctcacggactcagaaccagttgctgcaatactcaatcccttcggtatcccgatgcagaaatcaggtcatttactgcattatctgtaaaaatattcgatattggcaatcttaacaaatccatatctttccagtattggattgcccaccggcatgcagacacgaccatgtatgtacatacatcttgcgtcgcagatcaccaagcctcgtaaatcggcagcttgcacacaatccaatcgattgctaatagccgatccccaagctgaagtctcatcatcgaaaaatcaggccactcaggaaagaaacggggggcgcctcggctggattcgcgcgctgcgcagttgggaaaagcaaaaaagctagagctgagactgcggaggtgacatggcttgcatccatttgcatgaagaattcatatttcttttttctccccttccgcaagggacgtttggtgggacgttgaaccgggctagctccaattagagtatgtgtgtccggtcatgccccttgcataaaccagcctgcagacacggggatgttcacgcctctcaagatgcaatggtagagttgcaatgagaggcgatcttagactgagagcatcgctgcagaactggttcactggatggttggcgatggcttttgagataggtcatacgtagagtaacatccaggcatggcatgccgattagcgtgcgtgaagagatcaacccctgtttgccctcccgattcctcgggccctccccttgttgaggtagcacatgccctccgagtctggttctcgacatcacggtgcagagcgctcggagagagtgcttctggccatccctttcacagtttagttccctcctgtcatgccatcttcttccacaaggcgagacgaaaacggagctattttgccatccttgacatcggcgatttctcaacggcatccccacctccagagtattgctcgacccctgttcccaaacacatcgccaaccgatggctatggacattgtatctgagggccgtgggagttgttcttcttcgccagtggcggagcttacttaccatacgccaccgttaaggatctcggttaagcaggctctgattgaggaggcgcggggatgattggattggcaggggagtccctttcaatcatggccactctggcatgctagcggcatccattctagcccacacattggcgtatattggaaatgcgttctaaaggtcaaagacggaacgaaaatttcgtcagcatcatggcgtgatcttgctggaattgttttttcttgatcgtcccgttcgctgcaaagcggttgtgctggcaatccacggcgtccttcctcgactatgattcgcaagctggtgcaagtcgcaacgtttcgcttcttgcttttttcccttctcctccacctttagttcgcttcggggagctcgcccaaatggccatcccgcaggctagataagcattcgtttgggatgttttcttcttccttgccgttatggagaagttcggttacagaaaaccgcctgatgctgctcggtgggtggccaactcatcactttgatcaaagactttggaagttcgggtcactccggttgaaacttggacgctaagaaccgtcaagatgatcgtcttgattgatgagagggactatgatggaaggctgcctgcaaggctcccaatggcgcatcagccgcttgaaaccatggcctgcgaggtgcgacagccgcgtcttcgcatccccagttcctggttggacaccagaagtaggctttgctcgcaatattgtgggccaggaaggcatgaagcccggcctgtccctaacatgatgccgcttagctggcactcagctcagcgactccattggcatgttcaactgacaggccccagtccctcccgatgcctcgcatgtgagctggctctgtatcatggagtgattcgggagaaatatgcgaagatccacgccgttccggtcccgggtccagatcccatcatctcccatccgggatctacgaagctgggatgcatagtggcggccattttataatccacccatatcttcatatatatgcgctttgtcccatcagtcaaggatctcgttcgtctctcaggtccaagcatccggcatacaggcagatctcgggaagtttgatagacaacatgagttcggtagaggacacgagtgctaagccctcgaggctcccgcatcagacggacgagtatcttgcagagaacctgggcccgggggtggccactgtgtgtatcgtcctcacctctatcagcaccatctttattctgcttcggttattcacccgtggcaagatcatggccaagttgcacgcagacgactggttggcttctctctccgtggtgagtctgtgcccttctcgtgacccaaaacgtggctaagtggcttcaaagttattccaatgggcttgcgtggcatttgtcatattggctatcaaggcaggaaacgggagacacttcgacacgctgtcgatcgacgagagggagggtacaatcttttggactgtactcgcccttccgatgggtatgcttgcgtttagtattccaaagctgggcgtcgcagctcttcttactcggatcatgaacccaacgaagcagcacaaactcgccgtgtggggattgacttcattctgcgcgtcgaccgtcgttgccagcataatacttgtctttgcccaatgtacgcctatgcgggcgctctgggacctttcggtcgtggacaaaaagtgcattccgggtagtgtggtcgtggactttctaatattttctggaagtaagtgctccactagatgatggaagggaggaacattgctgacttcgaaaaggcgtgtccgcgttcaccgatctttacttggcactgtacccagccactgtactcttcaaattgcagatgaacatccgaaagaagattgccttgagtgtggctttgggtattggatcagtgtacgttttccattcgtcgtgagaccggagccctgctaactgattagggccactgttattgcaatcaagaagtgcacacgactgccagctctagctgaaaaggattttacctgtatggatggaactgcacccgtatttcattgattccgtggctaattcatgtcgacagataaaacgtcagacttggttctttgggtcgtgtaagttgaacccgcctgtccttgttcaattcatggctgacaggtctacagtggagagggaacaaccattattgtggcctcatgcataccgttgctccagcctctcgtcgatctcatcttcggccgtcgagctctgaatagttcggaaaataatgggtacagccgattccctgccagtcgactcgggtggaagaagcgagacacggagctcggcctgggaacaggcaagcgaggcgagcgtcataaagggacatcagtcgacgacctggtagaggtcggctcgcaagacactatcctgcggactctagactatgtcaagttggcagaccatcaccatgacgggaagcctggccaggacatgtctcccgccaaccgcatcttacgaaccgatgtcgtgacaataacatatgacaacaagagcgagaacggggagacagatgggacaatgggtataaaagaccctgaaacaagtggaaatggcaatagctggcccaaggcagaagctgtcgcattgtgatcccttctgctggtctttttctttgtctcctggctcgactgatccggcgttggcgttgtgggcaaattgattatgaatgtgacgggaagacgacatgaaacttcatgagtaatggtagatcgttttgtatatgaagggaagatacacgaatatatgacttaagactgcataattgttttgaacttgattgaagggtggtgatcgtctctcctcgacggctcctgccgctgttagaggtggcttagtcagccaaacaccagggcgctgggttttgctccgtgtcaagtctccgaccactctacctgcacctgatcagactttatgaagtcaacaggccgaacgtgtatttgttcccctatcaaactacgcatgtggaaagattccctggccacggccatggcctaatgtgcttgtcttgccccgggggtgggacggtgccgctttccagagagcgagctcgaactgatcaacctcgacgcgccgaccgcacgaagccttctcgtataccccgcccgagcctcgatgccgctctgacatcgttgcgcttcccgaatcggcatcgcatgctacggatagacgctctctgtatcgaacagagtaatgaggacgaacggtcgcgatgtgtcataaacgagactagtctacaaacttgctgcctgtgttgttgtacggattggcttgaaaatacgaggcgttgatactgcacttgggctgggtgcgcttgaagccgtctgggagtctgctcttgagggcatgccttcagacagcatgcagattagacgagcacttcgaaagcactgggtgtgtttacgagatcgcagcctgagctcttctaagctggtgacggatttgctgtacttcttgaaggctggacatagtttgttgttcatccgaggccaggttagcgtctatttattgggaaatgccgtctgattgatgagctattgcaacgaaagactaagatagagcggatgagaaggccaaaagaaggaccgcctggacttcccacgtgtacgtttcacttccgaagagaagtatgaatgatacgtataacgatggtaagaataatgattaacgtagtagacttttccttccttgtcgcttggtttgacaattgaacaagaggaaccgaatcatgggtattcgtaattggaaacatcctcaaacgccaaacaggctttgaaaggaagtcactaccagcttctcaaactaccaggcagttggtttcggttaaattaaacctatatctagagtaatagccaggcgctcagcctctagcttcttcggcgtcacacagagaactgaactcttgcgatcactagacatctgaatttaaattgccgaatattggccacttgcgggcactttgttcttcggtgtattgatgacacggcatggtgtaattgaagcaactgcctgagtacccatagctcgtttctgggcgacaaaagcccgaactgatgatgaatcgcccctgcttggttggagtagagacgacagattggaacgccccggtatcggatccgacaagcgatgatggtgtgccatctggggatcgttgcgtgatgatgtgacatgcactaacatcaacactactcctgcactgtaaccctcgtggggtcaataaatcccagggagtcgggacttgcccggtcttcacatatgatgctatgatctggatgaagactaactggcgtaccaaaagggcctatccgttcatttgctcaacaaggcgctctgtcgaccgacatccgccagaccagctagaacagtcgagcctcgtcagcgagcacagcagccaacatggcggctccttctactactgctaccccggatttcatcaatattccccgcattgatttgtcgctatctgaccatgaccagcttctgagtgatctccgatatgcactcacggaggtcgggttcctctacattgagaaccacggcgtgcccaccagcctgatatcggatctgaaaaacgcacttccccgtctcttttctatctctctagagtccaaggcggaggtcgctctcgaaaactcaccccatttccttggctacagcggtgatggtgctgagacgacggcaggcaaatccgaccgcagagagcagtttgaattcgccacggagctggatgcaacctggaaggaagggttacctcttcgtgaacgattaagagggccaaactctgtatgtaaagcgcccaacactgttctattattgtggctcaaccatgctcaactgtctaacggtcttattcaaccatgaaagtggccatcggcatacccagagttacgccccatcgtggagacgtacatccgtgaattgactgccctaggcgagcgctttctccgcctcgtagccgaggctctcttactcccacaaggcacattcctccctttcctctctgaccagcaccgcctcaagctcgtccactacccggcgcttgaggacccaggcgccgaaagccagggcgtaggaccgcacaaggatagctccgggtggtggacgttcctcctccaggcctcacccccgcacatcaaggggcttcaggtgctgaacaagagcggcaactgggtggacgtccccgtgatcccgggctctctggtagtcaacatcggccaggcgtttgaggtggtcacgcacggcgtgtgcaaggcgacgacgcatcgcgtgcttggcggttctctggagcggttcagcgtgcctttcttccagggggtgaggcgtgacctcaccaaagcagaggctctggatccgctgagggagcatttcctcaagcggcccgagtttcggtatcaaaagggccgcgtggcttcagagtctgacgaggggaggggtattgattctgcatttctcaagggcaagtatgatacttggggtgagagccagttgcggacaaagattcgcagccaccgggatgttggcaagaggttctacggagatgtgtttgagaagtatgtcaacgatgattgaaagaatgaaagaaaagttgacaatatttttccctttaagtgataccctcttgatgcatttacatttttaacaatcgcgtccaccccaaaagcacgtccctgttcatattcttcatacaaatagtcaaatcatgaactcatttctcaatttactaactacaaaaaaaataaaaaaataaacaaactcattcagtcataatacctcgccttgacccccttcagaatatcctcctcagccagctcactcctcgccgtcttgctcctattcacccccgccctcacacgagccttcacccactcaccagccgtgatcccctcggccagctgcgcatccggatccggcctgtaattgagcctctccagcaccttgctctgcaccggccgcagctccagcttgtcctcgggccgcacaaagtacagcacgcccagcctgtcgacgtgggcctggtccgcgggaggcgccacgaccctgtggatgctgctcctgaggaacccgttggtcaggaactgcagcgcgtcggcgacgttgacggtgatggagccgtcgaggggcctcacccacttccagccgccgtcctgcccgcgcacctgcagggccgcgacgggctggcggaacagcagagtgaggctgccgaagtcggtgtggcctttcacccagacattgttgagcctcgcgttggtctcggcgtcgcgggcgtggtatttcatgtaccgcaggtggcagtccgagagggcgtcgtagcggtggaagtgggagaagtggtcctcgggaagctcgaggatgatggcgaagagggccaggagcttctggacgacattgtggtggatgtgacgggcgaacttctcgatctggggcttgtgggtgttgatcactgagggctgcgggcggtccagctcggggatgaacttggggatattaaagatctcggtgttgtcaaagataccaggtgtcacttccttagtagagagttagttgcttggtgcagagtcagaccattgagatagagcttacccgtagcccgagaggtttgtacccattgtagccaccgttttctagatcagcacggtacttgagcttctcctcggtaggcagctcgaagaggctcttcccaatggcgaactgctcatcgacctgctcttggctgaggccgaaatttacgatataaaagaagccaacttcttgtagagccttgaacagctggttggcgagagcctctttgcctccaggctggtcgaacttggacagatcaagcgttaccagattagcccaatccactacgactggtcaatacaacgacctgacatgtcattcatctggcgaggaacaaaacatacactcgtgggcggtttctggaatctgcttgtaggtcgggagggcaccgacggggaacgaagacacagctgcagccatggcgagagtatgggccaagttcgtgcgtctcgaggcagtgtttctcaccagcccagaggtcaatatggggcaattgcgtgatatatgaagaggccagagcacggagtgaccttccgggagtagtatgaacttggataaggccggccgaacccatgccggagcccgggagtcttaaatggggccccccctggccgtgatctccgtcgtcggcagcagcccgatgctaccacgcaatccatctccgcaatggcgtctttcgagatggctcgcgtcgatctcaacctctgcagaagttggtcagcacagtggctactttccccaagactccagcccaacctgtcagtcggttatgtcccgccctatatgtgccatcgccctgggttgatagtgcataagagggttgcgccgacctgaaatctgccaatgcgagacctcgggagattcgaacaaggccgttggcgtgattgacaccggtcatttcatcgccatgtggaattaacgcagataaactaggagtgagctgtcatgccgcagctaaaaagaccttcttatccccggtgaatgaattgagtccatattgaagccggatgtcggccttgccaccctcctcggcacacgctacctccattgtaccttctttttccacacattgatccattgagggcgcttcgtgatcacaatattgccaaaatggctgacgggaaggatgttgccgtctcaagcaacaccgtgagctccgactcacccccactgagtgagactggcgaccggaacggggagactagtgccagcaaaccctctggtttgacctatgcccgtcgtggagaggaggttgatgatgctacagtggcacagggagtcgacggctttgacgccgagcgaatgcgggaccgggcgctgctcacagccgaagaggagaagaggctgatgaggcgggtggattggcgcatcatgactgtctgctcgctgttgtttctgctcaagaaccttgactcggacaatatctccaacgcccggatcatgaacaagggaacggatatgaatatcatgacgcaactgaagatgacctctgatgagtacaatctactcactgttttgtactatgtaagttggagttccgtctcagaagaacatgaagactgaccgacttagattccttacattgtatttgaagctccttccaacctgcttctcaagaaattctcgccaagcacttggcaatcgaggatcatgatcagttggggaatcgccctcttatgtcacgttccggtgaacaacaaggggggcatctatgctaccagattcctgctcggtttggtttgtctcccagcattctctagtcgctcagtttcacgatgctaatactcatataggccgaagctggcatgttcccgggcgtgattctccagctctcgtactggtaccgacctgacgagatgtccgttcgtctcctgtatttctgtaagcctaccgtcatccatacctacatgaaacacaccaactgaaccattgccacagacatcctcggaaatctgtctggagtgtttagcggactcctcgcttttgccttcgacaccgtgtcaggagcccgcggactcagcggctggcagtacttgttccttttcgagggcctcgtaacagtagtattcggcgtcgtcgtgaagttcatcctaccagactgtaagcatgaattgaccaacatacccatccaaaactcgtcgttcccagagctaacttcccccatcaaagtccctcccacagccaagtggctcaccgacaaggaaaaggccttcatccaagcccgcctgccccccaacgccccccgcgccgccgaggaggacttcaacatcaaggagatcgtccaggccctcaaggaccgccgcctctggctcttcaccctcatctgggccaccttcaccgtcggcacctcgggcgtccgcttctaccagcccaccgtcatcgccaaccttggcttcaccaccatcgcccgcgcccagctcctcaacctccccatctccctcctctccatcctcgtcatcggcgccacgggctacttcgccgacaacggccgcctgccccgccccgtctaccccctgggcgtcttcgtcgtcgtcatggcctgctacggcgtcctcgtcgcctacccctccaacggcgccgtctacgccgccaccctcgtcggcaacgcttttacctcggccttcttcccgctcatgtggccctggcgcgtccagacgacggcccgcgccacggggtccgccttcagcatcggcttcgtcaacagctacggccagatcggcggcgccatcggaccccagatcttcaagtcaaagtacgcgccgcggtaccggaccagcttcgcgagcgccatggggctcgtggggctctgcacgctcaccacgctcgcgacctggtgggtcacgcgcaagacggaggcggacacgaggaggctgaagagggcgagggtgagggccgagagggaggggctgacggtgctcgacgacgttgtcgatcgcgatctgaagcagggtaactctagttcagatgaccgtgtataagcaggattgggactcggaggaaactgacatgtaacgagaaatgatctaacatcgaggccgtattgggtatagaaagattagaaccgagctcatcatcaaggcacgccgctaacctaagcatctgacataaaaagcaatacattacttgaagattaaataattagccgctcatatatgtacatgactagttacagtaggaaattatactcgtgtgtgtagatgttgggtgattaacgtcgtactttttgttccgcaaattaccacccttatttatccctaggcaaaactccaagctcgccagtcgccgtaaatcaagaatttcaatgaaatcattctcatcggaaagatttcagttatcattatggtttttttctctttctcacacatattctgactccgttcggtgggaatgaagcctcggtgatccattcatttggcggcctcttcccctcatactcggcagggaacttgatgtcgtagttccgcaagacatgcgcgacaatcatcttgagctcgaagtcaactagaaacctgcccgggcaggcgtgtttaccatgtccaaacggcaggtactcgctactcgttgtgacaaatgtgactggcgcaccctcatctcgcttctcgacaaaccggaatggcacatacttgagcgcatccgggtatacatcgttgtctgtctgtaccggataagagaggaaggagacgagcgtgcctttgggtagattgtaaccctcgggggtggtcactccgtcgaccatcaccttgcgcatcatcgcccggttggcaaaggcgtgtagacgaagcgtctcgcgggagacagagtcggccaggatcatgctattcacacgggccttggtccattggcccttggaccgatctgagtcgtcctcggtccctagaatggtatccgattccttacgcagcgcgtttatagtgtcgtattccacatccgagccgagaatgtccagtagcaggttgcagacctgcagagtcgtttggtggactgcgccgaagttttgggcacatatccgcctgacgatgagttcgtgatcgttaatctcctctgggcgctctttcaaggcgaacttgaccatcatctgcacatggtctagaggcgcattcgtgttgccgtcgtccttttcctcagcgcgtgctatggccacgcgttccctccatagaggtatgagccagcgcttgaccttgctgatatgttgctggagagagattccaatgatgggtccgaagaggggctggaggacgttgggcaggccacagatgaggcctccgttagcgagcagaccgtcgttgatatccagcacggttttgagatactccgggtcgcgacctaattgttatcctctcattagtattcaaggcgaaaagcgaggcgtcattgtttctcatgaaatgcctgcacctcgaaaaacgaagaataatctcttacacaatggcagcccaacagtaaagcgactgttggcttgcgcgatggccctgctgatggtctctctcagccggaactcaacccagttctcttcgtcatcgccaaagtgcttgtcaaacgcacggccaagctcgtcattgagcgaagcgcaaatggcctcgagcacacggttgagctccgtcttgacaagcaatccctgccagctgtcgagaatagggccgtcgtgcccaagggtgaatttggcctggtccatctccgccatggcgtgggggacattgaggcgacttgccggttgcaccagcacccatcggatcatgctgggcggcagcagaacctccttgcgaaaacccattccagggataacgactggcttcccctgtttgagatactagaacccaggttagcaagcctggacgaaagcgccaaagtgcgcagggcgccgatgggttgaaggaagcgtaagctttctgcgggtgagttttacattgtcccaggcatccttaaaaagagccttgcagtctgtgtagtaagcccatctcgtgcgcaaactgaatcgctgtgcgccaggggcctctcggatcagagggatgttatcgggataggggacgctgacgatgaagcgctcgacgagatagacgacagcacagaaggcgacgccacaggcgatcaacgcgtataacccgagtaggtaggcgggctggcgcagcagcagggagcacatggtctgtttcaagatgggtcccccgccagcctcatcaacacacgaagaaaaagcgacgttgtgcaactccaagggctgcgttccgcgcagggagaaccaaccgcagcaccaggactcaggattgggctggcgagtgcaggagccccgttgcaaagaagtggcgtgccttggccgcggggcctgagcgatcagcgcctgcagtatgcaaggcaccgcaggctggtggtttgctctgcgcgccagaggaccaacgacggacaggatgatgaccagccggctgggtcgaccaattcgtttatgcacagactggttggttggttggtggcggcgagtgtcgcgggcaaatgcaagcgtgacactcgggagccggaagagaagggggcctgtatttagctgcagcttccagtccgcagtgctgggaccaggccaggctcaggagcgaagcgaagtccgcaactcgacgacacagtaagatccgccgcaccccactaaacaagcaagccagtcagctgttgatagtccgtaggttattgctggacggcgacagaggcgaggcgcaaggaaaaatccgttgctattgctgggcttacggctagtgggtgaccgctttcctctctcccccctgttcttcgtttctccgacgcttcctcgctttctctaccacgtagcttttactattggatgtgccaaagccaatggatgaaatttccagggtttcgggacttcggaggctaggagggccccgggtgcagcatcgaacagctgctccaccaacccagatgcagcggctgacaggcagggtcatttattaatgtgttgatctcgttggcggacccagtgggacacagttagtgggctattgctggcaccagacgaggcgaatagacgtgttttaggacacaatcgatcaaatagacgagcgactcagctcagatccatcgctgaagcacacatacagaaatgcgctgcacgtgcgtccgtgaccactctaaccgtggtgagatacctgtgcctcgcaagcaataactccggtgcttactgccttccacggccatatctgtcaccgacccagtaggtgcttgtcatgtaacttgcctgatgctacctactccgaggttcctccaacggcggaggttgccgcgcggttatcccaattacgcgggccacgaggaggagccgatttgatgtaattccctaccgacatctatcggacaagtggtttccagtggatagctgacccctatagcatagcgccatcgtgccttgtgcattcaatctcatatggcctggatgcagcctttgtccgacatggattgattcaataaccaccgcggctggaatgttccatatcgcgtctaggaattgaaacgcgcagccatgccccgaatctcagaaacagaggtgggtagtcccgcgtgtcttaaattgaatgcatggacccctgttttccaggtccagggaacagcagcgccatatgtcacagagtaaaacctgttgcctggaagaagccccttccctccaggttaggcgagctgtcaagataccgaggctcgagccatgactgatgcgtccatcgaaacgggataccagggcgagcagggtcggccgctgcgtggatagaatttggaagaaaagggggtctattcatttctcgtcgctaatcgctggttatagtgccggctcccgccgtgcctcaagtagatgtggggcctctgggaaaacgagaacatatcaccacttgctttgctgccagcgcggtgatagctatttccgtggcaggcggccgctctagtattcacctcatgtgcgattacttgccttttggaaccgtgacgagacagaccgtgccgcagatagtgactgctttccctcccaagtacaggcccccccctcgagccaatggaagagacctaccacttgcgacactcaaaacgaggggcagccacagtggctgcgataagataagcttcgcctgttctccccgccttccaccagagccgccatagcatcatcgcatggcgcatcacctactcagtgaacaacagcagatagctccatccaccagcccatgccggaggcaaatcccgccaaagtaaaccaaccatggctccgaaaccattcaagcctgctctcatcgtcgtggatttccaagaagacttttgcccccctgtaagtcccgtatgaccctcacgcctgatatcaaaaccatcatccatccctcttcccatacattcgcagccctacaaaaccacaccaccgcctaaccaccctcctcctccagaacggctccctcgccgtccccaacggcagagacatctccccaaccgtaaactccctcctccagctccccttccccctcaagctcgccacccgcgactggcacccgccctcccacatctccttctcccccaaccacccggacacctcccccttcacctcctccatcaccgtccaccaccccaccgacccctcccacctcccctacgtcaccaccctctggccggtacactgcgtcgcgggttcccggggagcccagctcgtcccggagctcgacgccgacgccctccacgccgtcctcgacaagggcacccgcccggacctcgagatgtactcggccttctacgaccccttccgcgtcgaggacacgggactggcggaccgcctgcgcagagaggaaaccacccacgtcttcgtcgttgggctcgccgccgactactgcgtccgcgccacagccctccacgccgtccaggaggggtacaccacctacatcgtcgaggagggtacccggcccgtctccccggagggctggccggactgcaggcgggagctcatcggcggcggcgtcaggatgatctcgttcgacggggaggaggtggcgcgcgtaagggcgatggcatcatgacgagcaacctggtattgggggcggggggggttcatgaggaaggagtatggggattttgggcgtttctgtgcaaattcaagatttactacttgtttctccatatttttttttttttggtttagaaaagattaaataagtatgctgcggtgggaaaaccgtaatctcaagcgtcttcaagacttcaaggtatttacatacgtaaattccgttcacccaattaaaaagatacgtttaacaggtaaaaaataatgaattagcgataattagagcacggtgagggcatggtcgccctccccttgcgatgggtatgcaaatacttctactgcgataatccaggcttctagacaaattcaaactcctaacacgacgcccaagccattctgtatgagatcaactcatcgcttagacctttggacggcagcagcactcggggtgccattggctccgttagtcttgtccagcgcagaggtcatcgccatagacacgggtgtcatggcggcagggggtgcgggagtgccgctgcgggatggtgcggcacttcggttgtgttgcatgtgggctcgaaccagatggccggcagcgagggcactgcagagcgacagctcaccagcgaggacggcggcagcaatgatgcgagccaagcgtctggcattatcacctgggtttgtggggtgagagccacggacacctagcatgtcgagcatggctgactgaggctcgaggatggtacctcctcccaaggtaccgacctccaaagagggcatggagacggcgatctggagagagccgcggaggctagtggaaaggagaataattagcatccaatcatcaaaaacatgggagtgatatggtgagcacggttgacttactttctcatggtggtgatacagttgcaactttccacaacctgggcgggatcttgaccagtggccaagaagatagccgccacgatgttggctgcgtgggcgttaaatccaccaatagaaccagccatggcagatccaatcaagttctttgagatgttgagctcgacaagagaatcgacatcactcttgagtacgttcttaacaacatctccaggaataatagcctcagcaacgacgctctttccacgcccatcaatccagttcagggcggcaggcttcttgtcgatacaatagttaccagaaaccgaaatgatttgcatatcctcgaagccagcctcgttggccatgacggaaagcgcgtgctccacacccttggagatcatgttcatacccatggcgtcaccagtagttgtcttgaagcgaacatagaggttagttccggccagggccgtcttcatgctctgcagacgggcgaagcgactagttgagttgaaggccttcttcatgacgtcctgaccatcttcggaatccaaccagatcttagcggcaccggcgcgttcaagggtctcgaagcccaagcaaggaccgcgagtcataccatcagcagtgaggacggtgatggcaccacctccagaattgatggctttgcaacctcgacttgcgctagcaaccaggacaccttcagtcgttgccatggggataaaatagctctgtccatcaatcaccaaaggtccggcgacacccactggcagaggtaggtaaccaatgacgttctcgcagcaggctccaaagacacgttcccagttgtaatgctcataaggaagcttggagtggtcgagcgtatgggtgagctcctgggtagccttggtccgagagatgatagttcggcgaaccttgacagcgcgggtgaaatccttcaagctcttttccaaagcgtatccagggatctttccacgcagcgacatcatagcgacctcctcatcgttcagctcgtgggcgcgcttctcggcaatcaactgctcaagagttggaatgctgcggacaacggtagagtcctgcttcagctttggtcggggaacagctccgtcaccctcatcgtcggtcatggcgggtgtagcaggctcagtgcgcataggagttggcggcacgtactcgccgaggggaagagtagtggtgctggtgtcattgaatcgctcagcattggccagctcattacgatcgatgatgcgatcgggcatgttgggatccttgatgccagctttggccacattgaagagatagccgttgagggcaacactgagagcgagagcgatgacgatccacttggacaagacagggtcttccaaactctgcaacaggcttccgaccatgcgaccgccgagaccgtatccctccagacctaggccattctcgaacagggagccactgccactaatggagccagtgagggcgtaatgaactgatggaaactcaagctcatacttgataggggtaagcacagttaccagggtggccttgccgctcgacttggcgccctgaagaagaacatccaggccgttggaggcgaccttgaaggggtccacaggagggctggaaacaacacctccaagtccaccaaaccacgaacggatcgtgttcagggaggtaggcgtgcggaatggaatggtgacgagattgatgacattgatcagaacgaatccagtgaccatgatgaccttgaacttgggcacgttgctgctcttcatcttgcgcccgaaaagggaagtctccttatcatcgttgccctcagccacgttttcagccacacggcggttaacaccgtcggcttccaaagccatgcgcatgtcgacatgtctcttgatgcggttgatctcgagcttgatgctgaggatagcagtgtaaaatgtgaacaacaaaacacaatcaaagaccagaatccaagcagcaaggaaacagaattgctgaagaccaccctggacgccagaggcagcaccgacaacaagaatgacgatctcaatagcgtaatccctgacaatctcaaaacctttgtccttgacggcggctttgatggcatactgaatgaggctctgggtgacgggttcggtacttctcttgccagacttggagttctggatctggacgcggcggtgttcgatggcatgcgacaaaacagccctggtgaggacaatgttcttctcgaaaccgatggtaactaccaagaatggcaggccttcggagagaaggataacactaatgggaacacccagtctagtggtaatggcgagaccaaacaggaaagcgaagacggaagagaggatcgtgttgaggcccagccaaaagttggagcccaagcgcctcatagagacgaacaaagagacgaacgtcaggtgcatagacaggtacccaagtaccatgataacaatatcaagactctcggcattcttgagcaagtcgaggaactcggaccacgcatctttgacccattggacggcgttactaggtgtagtgaccttggccgctttcatgatccacatcttcttctctcggccatggcgcgtctccgtctcctcggcatcctcattagggatctcttgggcagcggacacgaactcgggtgcctgctggtatgggagggcaaaggcgaggatgctatcttgtgcgtaggtggtgaacgagttctctgtccccgggagtgcggtgatggagaggttgctcggcgtggggacggtgtgcgagagcggggcggtgctcggtgaatcgctcgagagagtatccgggaaaacgagagtcaggagggcgagatgatcggcatcggtggcgggcgcggcgtcctgctcgacagactgccacttccacgtagtatcggggctggcgagaagcgtgcggctgccttcggtcagggacgaccaatcggccttgccggcgcggacacttcgatcgaaaaggctatcttggatcagaccgacgtatgaggtgctggcgagcagcgcgacgacaacgaccgtatggatcgggtgaccacaggcgagccgcgagaggaactgcaccatgggagtgattcttttgctcagccaggtgggtgcttggttctgtgctaccgagggctcgccccggaaatgcctggggaggaaagagttcatcgtgtctatatgttcggagaaggtgactcggcgtttacgacattggtttgtgcttttgatcgaagggtcgtaggatccgtctaacgatcgattgctcgagtctactggaggtggtaagccagagttttcttgaacggcagcgtccatgatgcgagggtgaagttaaatcatgtaaaacacttgaagacgaccaagagatggcggagccaattgggcagagggaggaaagggggcagagggcagaggcagcggcggctgcgcattatacagcaaacgcgtttgcatctcgaataatctggtgcgacttactcaggagcttggattgggctgctctgaagccgcagaggaggtcgcctcgctaggtggccaatgcgaagaacaatatcaagccaacgcaattgatgccgtcacacagccaaagccaatgccaccaaaggtcgacgtaagggccagagacgtaagcagtcacgaggggatgatgaggggggaggagaactaagagcagacgtagggaacggaaggtcgaggcctgataagggctcaagggagggacatgcagacgtcgcagcgagaatatttgcgtgcgtgcgaggagctgcatcggcaaggttgatgcagaacctcgccaacccctgtttccatttaggacagctggggcggtgagaggcagattgccctatgagagggcgctcgccggtggagctgccctggcagtatacacctaccctcgcccacatgcgctggaagtatgggtgctgtgccaccccaaaccagcgtctacaagccactaccgctgccgggctaggggtcgaccctattttacttttttttctgatggatgcctgtacttttttttatgccctttccgtctaggcggtatctacctaaacagcacgcgagccccctatcgcgttgcacccccacctgggtaaattccaaggcaagttgggggcaggcattttgggatttcaatgtgctccaaccaacgacgggcagagacacccctcagcccagatgcgaatgtgactctcccactcttacgtaccaagtttgttgcatctgtcttgccgcggggagctcagcaaaaatccctgcgtcatcaccgagccaccccataactgcaggcatcactcccggccagcttgggtcacaaaagctccattgccgcgtggagacttgcccggtccgggactggtggggaatcctcgttggccagagcctccgcatcaaacctcccattcactcatttattcgttagagaagaaggttcaggaagggatgtatgcacggggcgctccagggcctttggcatgcgtcaacgcaagctgattgtgtggccagggctagaggactcgcgctggtggtcatcctcaggatcgaaaagtcccaatgttagtgctaagccctcagcaagtcatccatattgtctctcaggcaggatgcccgctgaattaccattactgacacccacttgggcgttgcagaattcggagctatggcaaacccacttcagcccatcacttagaggagaaaagcaggatctgataataatcgcgctctgaaggagatcgccgaaagcaatcaccggcagccaaccatctcgcggcgatgtggcggggttcatgagtgactggctgcaggttcaaacgaatacgatgcgccggcagacccgcgttgctgccgtctgccggcgatggatgggttgcaacctacgagtattgccggtggctgtatgggaggaagccatcttcttgtgcatacacatggcgagctataccgtgtgctgctttcgtcctggttgttgccggcacttgaagcaacagcatttctggccgtcaagctgcttgcgtttggtttgttgcacatccacagtggaaaccaggcggagctcacagctccgtaacatggagctcggtattgactatgtgtcatccgttggaggggacaaggggcgcaccgcaatgtgtcgcacgcgtattcgggaaatcgatcacacacactctcgcgcttaagtacctacatgcatggatgcactggacggcgcactggctgtcattacattatcaagagacctaactaacattggccttggcagttgggttcccagtggagctgcttccaggggctgtcttagacccgtctcggggcaaaacggcacggatagatttttcggagcaaattcaacgcctgaagaatgcaaattctggattccaagcgaggattccctcagtgggaggtctagagagatccttatctcacgttggggtcgctacattccagagttgggtcgactagctcgtgagaggagggaggagttagacggtcataacttgtgtggcttcaggagcaagccacgttgtggtagcgcgcaaatgaggcgtctaggtgacaacaatgatttgcttgctgactacaatgcctcctaagcctgctcatgcgttattatggattgcgcaagacggaggtattgggttgaagatgcgttgtccttccaatcccgccgtagtggccgctattttctgactgccagttggggactgaatccgccagagcaattggccgtctgcgcaaccaagcatatcccatgcgctcatgacgccatggtcgaatcgggctagaaaaggacacgattagaattcgcccgcggctgtctgagacgagatcccatcctccgtttccatgtaaagatgtccaagttgcaggctaggcacagaactaccgacagttgtccttggcatggataacggccagcgctctgcttccaacccgacaccagcatgcggccatgcctatcactattaaggagaggcgcatctccattccgccgtattacaccgtgcagataccacgtttcaagaaccgtagaaggttgttttccaaaccacaatccccgggcctcgcaccaccagctgatcgacaggcagtcctgttgcagaagtgatgatcccacagtggtccccaggggtaattttggaacgctgcgcctagttctggtgcacggagtgctgcaaatcctctgcccaaacttgatattgcttggccccgtctccatccactccaccgtggggagattccatagcgtgcgagtagatggcttttggcgctggctgtagaaaatcactaattgttcgcactgccatgatgatcaagtcgtattaatagaggtacatacttatctgacaggtgcacggagtagctctttctccttatctgcccatttccactctgcccgcctgttcctctgctcacgggaaggtgcccgatcatctgcacttgccaatgtctctcacgtcgtctcttacgacactctaattcttctccttctcattcattagacagtgccaatctacttctaacatcgcgcattatcctctgtgtattcttgaaaccatgaagacccgatcttccctagcctgtgccggtgtggcgttgattctactgatcaccgtctttctctacaaccctcggcaccccttcactgtgccattctatattctctcggacgccagtggtctgtccagtcccgtgacccatgtcgccatcttcaagataaagccgtccacgagagccgcagacatccacaaggtatgtgttgaagtcgccgtgtaaccagccccaaccgccgtcatctctattaacgccgtcttccttgtgtctaaatcctagctcgcaaatggcatgatggaattgaaagagaaatgcatccacccgatatgggaaaaaccatatatccgcagcatccacggtggcgccaaccacgctgtggaaacaaaggtaacccgcccgatgacaagagatagaagatgcatgatctgacttctcctccaattactgcagttcggtatcacacactcgttcatcatcgagtttgatgccgtagagcatcgcgactattatcttttaacggatccagcataccagaagttccgagaaaatgtgagggactacctcgacgatgacatcatatcgatcgatttccagcatggcaaatatacataatgaagtacagtacatatggaggagcatggggaatgtcctccaaatggcaagaaaatccccaaatggtaataaagatattcgagattcacaacctcattactcgtccgtgaagcacactgtctccttgctgtaccttaagggccagccaacaccagaaaacaaggggagcaggacggaacgcgtcatctatcctacatatcaacacgtaagtcattggtgcccagcagcctgtaccgcccttcctcttcaaggcgtctcgtcgtcagccgatccggatagtttcgccaaaacatgttggtgaaatgcgtgccataatggattccgtccacgggtggctgtgctctgttgtatccctggagtgggcgcaccacagcgcggaaatcgggctcgtggaagtatgcaaaggcaaagcgctcgcgcgtgttgagcccgaccttgtgtggtgtggccgatagcacggagttggtcatgtactgcatcatgtctcctgaaccggcattagcaacgaatcgaggtcgttttcacgagcggcaagacactcacccgggaagacagtgaatacaccaggcactggcggcacaaagacccagccagattcatcctccagcagccctgcagagctcttctcccagttggcatacctctcgccctggcttggtgggcgaatgaacaagcctaggctatggtcagaatgatctgcaaactatgctcacatgcatcgctcttcttacctccaacatcatcttgggcggcgataatcaacagcccatagtctgtgtgtgagccgatcccccggccttcctttcctctgccattggtgcgattacaaggcggaaatctttgagcgagatgtcattagtaacgggcctgttgctaagcaagtttcggggggaggcatacctaagcatccgcaggtggtgccagccatctccagtgtacttggtcagggattgcggcggaacatgcaacccaaactcgatgagctgcagcattctctctccgttggctgccagatcgtccatatatctctggatgacattggccatgtcagagtcaggccaagggcaaggcccatggcacggccagccattcatgactcgctggtcgtccagtgggagatctttggtcaccgtgaagatctcagagtagtcaggtattccgtcggtgatctcttcacctgaggcaatgtacccggcatagctctgtgcatccacacatgcggctttctgctgatagggcctgcgaaagaaacgccggcttattctctgggcctcccaatagacctgctgctgttgccccgacatggccacttgcaggatgccatctctccgccaggcctctaccattgccttgcccagagcatggtttgagggcgacccatctaccttctcgggcaagacaaacgttttgaagcggccaacactagcaacaaatccaggtggtattttctgtgcagcagcagctgtcgtgcatactgacctgccacaggcggccttgattaggctcagtacctggggacggcgcagtgacatggccattatcttgtaaagattcatgtattttaatggcaaactgaattgctaattcccaatgactacttcagaacaggcgagggggtggcccaaagatatagacgggccgaaccagatgatggacaccatcatgccgtctgtcaacgctacccgcagcagcctcaaaattcgacacgcagcaaacttgggactgctatcttacgctggaacacgtacggcggccacccgtcgcttcccctttcggcccctcctcgtgccagctatcccgcccacaagggcatttggttcgctgagacggcgattgtggtgctaccctggctttcgtatatcagatctcgtatgcaccagccgggacggtgcaactcacgaggggctaccgatgtctgggagagagaaaatgcttggcccgagaaatgctgcggctttgcgggaagctacagcctagagaaaatcctgccgtcggctgcatgtaatagatccaaatggcgtcctatcagttcgcggcttagcactgtgggtggcatgcaggtggtgtcaccgcggggtgcctcctgtgtcagcaattgacagtgccgcagccgtgtcgtctttcaatccggcgcagtcaacctggactgggcagactgctcgaaacagccttcgggtcgatgcatacaggatcggccgctttataaatactgcgggccatttccatcaactcgagtttcatgtctgcactgccgatctgtcagacatagcaaaccccgtttctcaggtctgctgggggaaatcggttatttgcttgcgtaggacagctagacgggttcgcgcgcgcacctgcttccgcgcgcatcaaatggcgggagggagcatcacatgtctcagacagttgcggatagttcaaacggacaatggggggggtcgagcgaaccggcggtgtagatgcgattcatcatcttggataccgcctgttttgcagcctacgcaggacgaacgcctgtggcaaacccaggtcggaaggccgtaggcccagggagcgcaagagaaactaactaattcaaatgctgtgggagcagtatgatatatgacaacagcatgcaagtggccggagctgcaggtgcagcttatggacgcacggctgtcacacacctggaagggctagcttgcctgccctcacggccagcttcggtatgatctcacaacacttggcgcactagaatggctaagctcgacaggagtgaagcgagctgaggggaagttggcatcactttgatgtaagggcacaacctggtcgtcgaggtaggagaggacgaggtgtgtggagcggcggcggagatcacgttgtggacggtgaggacttggctacaggagcaacgggtgacaatgaatttgagacactcgaaacattgttatacttcttattttcgagcttgcggctggtattatcagatcgttgagggccaatagtatatgcccaagagacgatacactaaagattgtcaattcatatgctttgtaatgccgcattgcgttactcatcgtagaaagtggtctgctcataaattccctcgaagttgatggctcagttattctgtccctagtgacgaggtacagtttggggtatcgcatccctgtcagcgcttgcattgacccggcgattgatgcacctcgcacgcctcagtgggctaaactcaacttcaagatggctgcatagtccattgttagaacagcaccatttacttgctgttcatgaaatagaattacacgctaaagccaatagttgaatcaaccaactcagggtatcaccggtgaatgaaagtgcatgcatgcctcgttccaaacacaaatgaatgacatcctaaccttgtccgagtggacgaagccgtaaacccccgtctcccccagaaacgattccccccgcctcacgcatcttcatgctccagcccggcgtccttggccttgctatcggccagctcgcacagcgcgcgccactcgtccccgctgaccctgctcacgctcagccgcgactgcttgatcatctgcatctgggctaagggaccacccgcggcgcccaggtcgcggagctcggggaggaggatgggcacggcgaacttgcgccggaactcgacgtgcaccaggctccacctgggcttgtcgcgggtggactgggggtcgtagtatggcgttcccgggcgtcgggcgctctctaggtgtaaatagttgcgtgagtttggtcttttgcgacatgtcacgaaacgatgggagagggggggggatttggtgtagtggtagtggtggggagggggcttactgtcttccgaatgctctctcacaatctccattgtgccaacgatgccgggggtcttgcagttggagtggtagaagaaggctttgtcgcctgcattcatggctcgcaggttgttgcgtgcttagctggcgcgttagccgttggtcatccgaaacattgggatggtgagcgcacctgcataattcctgattcctatttcgtctggtcagccaagatgatgcgaaccaaggtcttctccccatgcacaatggacaataggtgggaagaaggcgtgtggggaacaactcaccgtcccatccttctggcttcgtgcatgcgcgcaggtcgtcgatggagaagcgcacatccacgcccccctcgaagcgcgactcgggctctgccttcatgagccagtaccactcgccgtcgtggcggacggtctccgggttctgggccgggagggacgctgggtctgggtctggcgtcacgcccctcccccccgaggctgaaggcttcttcttctctgcctcgtcggtgtcagccgccgcctcgtcctcgtcctcagcctcagccttgggcgcccccctggacttgaccctggccttggccttggtctttgtggcgacacggcccttgggctttgtggctggtgcgggatccttggaggcaggcttctgcttcctctcctgctgcttcctggccgtcgtggtggtgggcacagccttggctgatgctgtggctgccttgtgctgtgccgtcgctgctgacgctgtggcggcggctgttgcctggcgggatgagcgtctcttcgcggtgggctcgccatccccagcagcgtcgagtgcgcgtttgcgaggtggcatggttccgcgcaacgggagtctgtgtgttcgggaactaattggttcgctcctttgcttgttcaggagaggatgtgtttgggtggtcaaggacaggactcgaaagggcagggagatgacattcgatgcgcgtcttctagcgcgtgtctgtgaaatgggcaaagtcaccacacgctttgagatctaccctgcagccggtgagaaattgccatgattgatgacggaaggcaatggaaaaatttgttgtcacaattgcagtttggcactgggacttttgactttcctatttgatttgattgcctgtccatttctattcttactctcagctcgatttacatgggcttattgcttacccgtgcttgatgaacggcccgccaccggtgaagtggagtgggacctttttccacattggcctgtgggatgcagccgacaacgaggaattgatttcaggaacaggctgggctagtggaacaaaggctgcaagtcaatccggtagcgtcgtgcacgacatacatcatcgcaaagaaaagttaccgaaaagctatgcttatatggtggttgtggtggcgaagcacgggtgagcaaacaaggtgtggtcacagcgatccaggagggtgatgtgacatggaccgtcaatcgcaaggcactctgcttgggttttcatccacttccggaggcaggtgacggcagggtatttcggttgactccggaagtgggtaggaggtaaacttttcacgatggcacgcaccattgagggactgcggtcgttgacgcctgggttaccgaccacaaattatgcctgtcacccacctctccttggcccacgcacaaatgtgtaggaagaccagtagacacgtccccaagagaagcaaggcatggttttaccgtccatcatggttacgggggccgtgccgcaatatcaggcagaggccacggcgggaggaggccgcggcggacacaggcccaggcgttctggcagttcttgtgactttgtctggcatgtaacgtggtctctgcggcgatgatgctgcgcggcagctggatggaggacaggttgactgatgaaagttaaaaaggcaattccatagtcgtgcggggaggatggacgtgaaggaggagtgacctgaggaggtgacgttgggcgaggggtgatgtgattggctggcttcgaggctgagcgtggctcggcctcccaccttataaagtcccctcccccctccccttcatcctcccctcctaccttctctcacccccatctcatgcaatcattgccttttatcaaataatccacataaacaatccagattcactcggatttggaagacacatcaccagggacactggactcattgcttggacaacctccgatcccggctatttacaccaccgtcgttgtgcacggccaggtccatatcagtcaaacaaagctttgttgactcgctcaactacatcatacaacatgccgtcaaggtacccgccagtctctccggacatgctgcaccaccctgaatccctcttccgtgaggaggatcgcagcccagcccagttcgccagggccagatactatgactcggacgacagcgccttgaacaggaccggagactaccgcagcagccggcgcagctacggcacctgctgcagcaagggaagaagcgtcagaggcggcattgacctcgagccattgttcagcaggaggtctcactctggttcgccccaggaatcacacggccacaggcgctggagcagacgcggcgtttcagcggccaggacttgcacatgcaagaagccgctaccagaaccggactacatcgtcttctgcccagatccacccttcgaccaggatgcagagaccgaggaggacgaggaagacgacgacgaagaggagcaaggggctgggcatggggtggcttatccggacaacagcacggccatcagcccagagtcctttgtgacgcccgacgcagatgactcgatagagccacgggaagcagggcagagggatcaatcgggagagccggaggaccaatgggatgaagacaatgaagcaactcgtcatcaagccaagggtaaggcatccagagaggtggcggggcatggatggcccgagcagcagagactgacaactgtcgcagtgatgagtgccctggagcacatcagatggtctagggagcaccgtgcagagccgggctaccgaccgcacaaagaccggacgcgtcggttaaccagagacgagtaggtagggtggccgtgttgggaggttgcagatctggggatccacattctgatgaaacaagagggaggaaattgcaggaaagagaggtgagaagggatacagtattctcgttaccgattagctcgagtagttggcagtttccatctgagttgggttgcatgcatgcctctctggtggttgcgatgcatgtaatagatgcggtcagtgagtgagtgagtgggtggagcgaatgcgagaggcccaattcgttctaattttgggatggtgggtcccctgagtctctgcctgagatccaaggcactgagccaagcacagcccaactcactcagagctgaaaagtgaagcgggagattagagaggcatgagatggggtggggccataacagaacacgacgcagggcctccctccatctcaccatccaactcgtttattactatcgccatgaaattgttatccatgccgttgcatcgtgttctgagtctagcgccgccgcgggccagaagtgagactgaccgccgacataatgagtgagtgagtgacagagtctgggtgagagagacaatcaaatcaatcctagtcaattcctgtatcatacttgatgtagtcgtaactcattagctgttctatatgagcccatatgcgcaaatgcccgatggaccgcctgcttgcttttgccagccgtctatcaaatcgccctctaggtacgtgtaatagcgagccccctaaatcacatgcctgattcgctcccaactccaagcaaaacgtaccccagaccccggccctccgctcgaatcgtccgaccgcctcaccgccccagtctgacggcattggcggtctcgtcccgcgagtgtttcaaaaaggggagcagcgccgtgcccccagtgccggtcagctgccccgtctccttgccgagggacgacgaggcgctcgccaggttctgccggctcccgccgttccacctctgcctggacggcaggatgatgtaccgcgtgacgatgcggatgtgcttgttgcggaagtctgtcagcgcgtcgatcgccgcgctgtacgccgcgctgagcctctcctgctgctgcccgcctccccctccggtgttggctgccagcgcgagctcgcggatgctgcccaaccgctccacatgcacgaggaaccgtgcatgagggcccggcatgtagtctcggacctgctggtggaacgtcttctcccctggcgggggcgggacaccgccatcccccttgtggtcgacgcccagcacgacgtcgaagaactggatgagcgagctctgcccgttgctgcccccgcggagctgccgccactcgccctgcccgtcgccctcgtcgaagaagacgcccttgggcaggcccgagtcggccatgttcttgctgcccgccaggaagggccggatatggtggtagaagaccatggggtcgcagtgctcgtacatcctctccaggagggtgccgacctccttgatgcgccgggccagctccccgagggcgtcgatgatgacatcgtagtctctcgtcttgatggcgttgagcgcctcgagcatcgtgtcgatgagcccggccccgctggcctccatggccacgctgatgaggaggaaccagtcctccgacttggagcctgtgaaggagacgagcgtcttgagcgactctagatctgtgaagtcttgtcccgagcaagagaagttccacaggttggctgcggcatagctcaggacgggtgggagttcgaggtgcgaggacactttgaggaaggggatggagatttgtggggggatgatctgcaagagtactgttagcaactggcgaagcttcaggatggacgagacatctggtcagaccgtctcgtctgaatggagttactacgtacctctgctggcttgtcacctccccaaatatgggcatgggtcataaaggccaggatgacataggctcgccgccattcttctaccgactgtaatctgtctgtggagagaaccgggagatcggccacaaccttgcggatggtgtcctgttgaatgtgcttcggtaactccctggcgatcgcttcccaaggctcatagtatgagtctggtagtctttccaaggggctgctctctggaaggaaggcattacgggtgacgagaaactcctgcaggtctgcctgtgacttctgaaagggagtctcgaacggtattgcgtgtggcgacatgattggaagctttctttctttgagttgagctgaaaggtagggccggttgcgcgaggttctcttgtggtttgactctctgtattagccaatggtgctttgtcttgctgatgatgagagaaacaatgacgcatggtagttgcagagactagcaatatctataagaatccattgaagaggaattgagggagttgtttgtctggacaggacgcggctcctagtctcccatggccatggatgcttctcccgtgggccatcgtcatttcacggaagcttcattctggcatccgcttccgcgatccactacggatcacaaggcgcagaaagttcgcgcactttcaaatttgatgaccccatgatgctggatccgggcgcagggttgaggtaatattatcttgaatgatctacttcattatgctgtcatgaaagcccagcggttggagtacacacgtgatgggatttccatgcatgctggatagagctccgtggtgtaggtttgtcctggtgagacatccgtcgcatccctcccccctccaacctgttggtgtgccagctctacgaatcgccggttgtagaaatctcaaaagggaagtacctatctcatgcaggatgcaagatgaggtttagatcaacagtgggaggagtgtcgtgttggaggaagcgaggaagtgtggaggggcgagcgacgagatggtggaagcacggaagcgcggaagaacggaaccagtgaactctcttgcattcataatcagtgacggcaggactctcggtagaagaggtggatctgcgcgatatcgcagattgacgaggagccgcttgtgcccgcatcggagaaaacgacgacccccagctgtcggatcctggtgcataaagtgagtgaactgcgacgctcttgagagtccctgagggtataaaccatcattttcgattctagatcctcgttacaactgctcacatcgtacgatactgcacagtttgctcccggatcacgcctttccccctggtctgatagctcatcatcttccgtctctgaccccggtcttcgtcatggagctgtcatccttcgttgatcgtcttcgcaacggcaagcctgctggcttcccttccgaggccaacaacctctcctttgcccagagcctcgatagccaagactcattaagccacctgcgggacgagttcattctccccaccagggcgtctctgaggaagaaggctctggacggaaccattcctggtgtgtgctctccccgtcgagctatcagcctgacccgtgaagctgactcctcccccctcatgatataggcaatccctccacaaaacaaaatggcacaagcaatgggtcatccacaaacggagcctcatctagtgatggctctgagcaaggcatctactttgtgggcaattcgctgggcgcccagcccaaagctgtccgcgagtacatcaacgcccagctcgagacatgggcctccatcggcgtcggtggccacttcaccgacctgggcaactcccccttgaccaattggcaggacatggccgccgactgtgccaagaagtcggccgacattgtcggcagctcgccctacgagatcgtcatcatgaacacgctcacggccaacctgcacttcatgatggccagcttctacaagcccaccgagaagcgccacaagatcatcctcgagtggcggcccttccccagcgactactacgccatcgagagccagatcacctggcacggcctgagcccggagaggagcatggtcaagatcgagccggacaagaacttcctcatccccaccgagaagatcctcgccaccatcgacgagcacggcgacgagaccgccctcatactcctcccgggcatccagtactactcgggccagtacttcgacatcccccgcatcacggcccacgcccactccaagggcatcgtcgtcggctgggaccttgcccacgccgccggcaacgtcgagctgaggctccacgactgggacgtcgacttcgcctgctggtgcacctacaagtacatcaacgcgggcccgggctccatcgcgggcgcctttgtccacgagcgcttcggcggcgtcgagtggcccgagggcaacgacaactctggccgcccctcgtaccgcccccgcctgacggggtggtacggcggcgacaagagcgtgcgcttcaacatggacaacaggttcgtgcccacggccggcgcgggcgggtaccaggtgtccaacccctccgccatcgacctggcctcgctgtccggcgcgctgtccgtgttcggcaagacgacgatgcgggacctgcgtagcaaggcgctcgtgctcacggcttacgccgagtatctgctcgacgagatgaacgccgagtcgggtaaggagctcttcacgatactcacgccgcgcgacccggcgcagaggggcacgcagctgagcgtgctgctggccgagggactgctggacagcgtgatcgtcgcgctcgaggagaacggcgccgtgtgcgataagcggaagcccgacgtgatcagggtggcgccggtcccgctgtactcgcggttcgaggatgtctggaagttcatgcaggtcctgagaggcgcgctcgggctgaaaaaggagcagtgagatgggatttggatgtgagagctgggtgtaaaatgacgactgtgacgggatgaggggggattacctggcctgtagcacgtatgacacgaattgaatgaaatggaaaaaataaataaaaaatattaagatatcattttgtgtaaattatcctattacttgactgttcctgtctatacccttgttgaccatatggtggttcgccttgtgcgactgctatataacccacctaaaaaacaaatacgcatcatcccctacccagtatgaagagtacaacgtagcagtcgctttggaatggaccgtgattacatgtgaataacactcattgtggctgtgtgctaaggtgtgttgggcatgacaccaccgtaaattgggggagcgaggaaatcccccggtacatcctccaaaggaggggcctgggaccagtcagtaggtgaatggatgtcatcgcatgatccccagagagcaagaaatacctggagatcctttgcccagcggcggacagcatcgtaatccttgcacatgtgcctggtattgaaatccgggaaggcgttgggcttctcgggatcaacccagacctggccgaggacgccggtgtcgacgttgcacatcagcacctggcggatggtgtccaggcagtgtgcttgagtaggtcagtcagcatgagaactgttgaatgacgtatgagggtggttgcagttgcatcgtggtcgagaaataagcttgtgaacgtcgctacttactgacatgcaggcgcagaatgtactcgtcgttcttgaaggcatggtggcccagctccctgtagtggtcgtagttgaagtacagcgctttccggactaggttctgggttgcatgagagtcagcatcgagcatgtgaatcaagcaccatcagtgttctcttaccaggcagtggaggtgatgcatgccctcgacgtttacgatgaacccgcctccgtactgcggcgatctctgcgcatacgattcgtccaggccgctggcgagcccatcctcgtaagaaatggcacctgcgcgatctgttcatggagtttaatgatagttgttatgagagagacagcgtgctggggaaaacttacagtcgacgccgagcgcctcccacgcggcgtccacttctggggacccgacttggcggtagatgttctcgttcatgaatgaaccgttgaagtctacaggagcatatctcatctggatatcgcgaagaaccggagctgcgttgtgcaaacgtgttagctatcatcgtgcttccctgcattgagacaacagaaccactgaggcaagtgtacatctggtgtctctggtctgaacaatgatgaaatgaggatgcctacaccacatggacgtgcgtgccgcgcactctgggcctgctggaggtgaaggtcgctgttgggagaaggagagaaactgcagcccaatcaccgccgacacgacgataaagaggacgaggatggtggccacggcgacaatacggaagactggagacgacagccatggcccagagcgagtctgctgtctcgaagaccatgctgcccgactccgcgacgactctgggccgtcgtcgtactcgtctgaatcaacatcctgaccctcaacgagcggatggtgttcttccttggccattatggtgatgaggtaacctcccgcgagctggagctatgtaaggaatggaggaaaaataagcgaggagaagaggcgacagagggcagatgtgaaacgggagatgcgagtgagcactcgacctgatcaatggcagcagcgtggttttggtttccactgcagccggactgcttgccaggcatcctgctccctcaccggggcctggtatcatcacgttgcatcacagaccagcatctcatctctcatatgcagaagaaggttcactaacccgcagcgccaacaagccagcttgccttcgatagcttgggaccggaccaatcggggagtaatcaacgggggagatctcaccggtcatcgctcacttcgtcttccccccatacagaaattgagtttgactggaatgtcgtcccgcagctatagtaggtcatcactcgccgcctatcaaagctcccattcacacacaagtcccccgcattctcgtatctcttttcccggcccacacacattcatcggccagcggctagtatctgcatgctacaccgtttccgggcgtgcgtgcctattgagggcgagttagcacggctcgcccgattctagacatcgtgggcagtgatgtgagacaagacccttggagatcatgaccccggtcacattccgcacagcaggagccaggtcgagttaaattctcgactatctgaaccttgactagacctcgccttcgattccgtgcttcactagggctcgttgcagtaaggcgactgccctatggcattcccctccagctcttggtcgccgatgaggttatcctcgatcaagctggcgatcgcgggtggagaacatgtttgagcatgagtatcatgtgccgagaattccagtatcagcctctgatctcctgggctgtcaggccagagcattaaaggccttacggctccccagataccctctccatgatgagcctatatcaccaactggcctcacaactctaagaaacttgactgttgataccccagcctgctcgctacatcaatcacttcttgctcgtcacgcttctcctcccgaaacatgaagctcaccatcctcgccgccctcgggctcgtccccgtcctcctcgccgcccctgtcccagaggccgagcccgaggccaacccagccccagtcgccgaggccaacgcatccccagaggccaacccaggcgactatggcgactatggggactacaagaacacgggcgtgggcaagtacggcgactacggcgactacaagggcaccggggttggcaagtacggcagctacggcgactacaagcagcccccagagggagggtacggcagctatggcgactacaaggacgtcaagcccaacgggccccctacctatgccagctacggcgactacaagaacactggcaagccgaccacctacggggactacggaaactatggaaagtacggcagctatggcaagtactaggatgcttcacggatatgtgcgaaggggatggggaaggggggtgggagagtgctcctgggaagctgatggaggatcgaggttgtggtttagtaaatgatttaataattaatcctgtttccaactagtatattcgtgtctatgactgaggtgaattgacaaggccacccaaactcaattatgtacaagagacaatagtgcctgactgaggtgtggttgatgcgagccaaggtctttcaataagctatgtctgaatcgaaggcagctagccaggtagcatccatcatctacacgtagtgcgcttagggctgagccttaatccccaaccatagttctgcatggaaagacttatgttcaaaggagaagggccgcggtcgccagctacgtcatgaatccctcgagaggatacggcctggatgccaactatgcccggcttcccggcccccctgtcgggctgaccgttggtgtagggctggggagataacttcacgccaacggtgctattgatcggctagatggagcgaagtttcagctggaagcaccttgtgaatgatttcgccggaaacggaatcttggcagagagtgatgcgatcatagtccatgagtctagtcccttcattgttgtgttggatttgcagtgtttgctgcaagagcgaagcaaatgctgatgctaaaaaagcaagaacacatccaagttgatgtcgtaatggcattaaatattggggaaagttagtgtgaggcggcatgtctaggttctatgtgctgtcaaaatgtacaatatatcagaatacttttaggtatgttgagatattcataaaccagaaagaagtgttgaatcatcgcagatgggaggactagagatgatgcgcgagatcgatcccacccccggcatcaagtaatggaaacagattgagtgcagatccttggtcattatcttggagatatgacatccagaacgttccgtctggtgttggcatcagcgagtccaggcccatgaaggcagagtcgaggtttccaaagcggggggagggggaaggaactgtctgcatggatgtctgctgcgagtagggccgatcaaccgactcgcgaggcctggggattggactcgccacctgagaggacgagtacgtagtagcagatcgtatgggggatcggccggtcgggctgggtttctcatgtggcattagtccgaaaagctggcttgagctctccgtgcggcgaagcctttcttgcagctcgcgcttctcgaggtgctctagtgcggtcgtgagaagtgattgggcaataagcgagtactgggtggcgtgggtgtcgaactgggagaagtggtcgagggctctgatggacattcgtgtgtacttctcgaggattcgcccgaagccacccagtaggcccacgcctagaacgagtgatgaggcgaagagccatgagctattgtatgtggcgtcagtcaagttccatctatcagtccggggtggcggtgttagtctggacgtcttcttacaccaaaagcggcacgggaccattgaggacttgatgatcaatcaattcgaggacggggtccaccatgaggctggcggcgtcgatgcatgcgtctgcgagctttgacttgccagagatcagagtgcttgacgacactgtgccgtgtgataacggattgtccgacagccgcctcacaagctcatacatgaggaacgggcgggacactagcatcacagcgtagtagtatgaagaaagcacctggcatgcgccaacaacatcagcctggctgttcggttcgttcatgtttgcaatcacattcttgagttgttgaagccatttggacgaccagtcacggagttggagagaaatcccttcggtcagctgcagcgatatcttcttgcgcgagtagatttcgaggacgatgcattcgaggatgagaagaatctggacagaggcgttcagcaggtcaaaaacctcattgccgtcttggtccaaggatttgtaaggcactgtgcagtcgacatcagacgtggagggaggccggcccatggatgcgctcaagaacaagtctacgacccgcaggctcttccacagcctgtctctttggcgatgaatctctggtccaaagcgagcatttacctccgtgcggtggacgccgatagagtgtgccgccctcacagcaacaccaaacaccagaaaggcgctgtttatctggcatgagcacagcatatacacggtgatgaggatgaaggcctggatggtcccgactccgagtttaccgttcaagctcttccaagcctcatcacgagcatattcaaagtatacttgggcggactgttggtcgtgtttaaggcgaccgatggcaaggacgaggtagtttaggatcgacgtcagattgtgtggcttctgctcgatattcgcccacaggagcaggtcctcaactaaccgggcctcgtcaaataagtccactaggcccctggtcgccgtgatatagttcgacacggcggcggcaatatggatcggccggacatctggggcaagattccgagcggacaagagaccagccgtcgccgccgctggggcattttccaagacggagtaccggctcgtctcaggggcaaaggcatttggcccgacgcggttcgtcactagctgccgaaccgactggaagaaggacaggggcgcacagtcaccgatgaagatgagcttcccctcggcgtcacacaggagacgggcttccctgggaacctcggtgtcaccgtctgcgtcgtcaacgggaccgtccatgaccgcctgggtagttgacggccgcgttgaggccgcacgggaaggaggagggagagagggaggaggctctgccgtgttggaaacgccgccatggctgctgctcctccgtacgacagcagaaccttcccgcagcggcacggacgggagaggggactgcggctgtgggttgcgatgcgcagacgctgctggctgtgcggttgttcgcgtggcatcatccgctgcatcgactccatcaccatccgcaccggcttgaagcggttgccgtcgcctgcgttgcggtttcttctggggagagtagtggcacagctcgggccggcggcgtcgcacgcagaaactgcagggttgttggccgtcgcattttgccttcctctttttgcagccgtcacacgcgttgccgatgcgagatttgataaacgtgggttgcgggttgtccatgcgaatagcggcggatggatgggcggatggatgagagtgttttggttggacaattcgagtctcaccaatcaatcaggggagtagcgaccaggtttgttgggacagcggatcaactgagttccgcttccgtgcttccgcacttccgtgtggcttccgtctgtgcacagcccaatcaacaagcctccgatcaagctccaggcgagagcaactgatacatgggaccaactgcgcctttatcttcaagcagaacagaaaaagaaaatatgggacaaactaaggaatccttgtttttgtttacgtatctcgatggcttgcagcgggccgggttgagcccttggcggatctcacccccacggtgggaaaagaggaaacaaataacggaagcctggactgacgcatcgattctgctgaaagcaaccttccgcacaatttgactgtatcttggcgtcatgataaaactgcttgggacgagctactctccacatgactgctttcttagctacgcaccttagtttgatagcctgctcacatcacatgagcaaacatgaacatatgtgtgaacccattgaagaagtggtaccatgggaaaacgagctgttcctattgccaattggcagaccgggccggtcatctgatgaacccttatcactcgactgctccccatctttgctcaatcatgctaattgaacttatggctcgagctgttttccctctagcaagcccatatttacaaaaatatatccaatgactggcatgctaaattaaatggtccagctgggcctctgatgccgtgtgtgcttgtttgatgtgctgagcatcgttcattagatcgcatttatctccgtaaagctcagttatcatgcggatatgaggggctgtttgcatgcaacaagcctcatgtaagaaagaagcctgagatttggcggctgaccggatattgcaccctcactgagaagggttattatccgagctccaaatctcacgcattgtagtataagcgagctgcttatctttcagttccgtcactgacatcatcgatgggaaccaacttgcaaaatcatgattacatcttcgggaaaaaaggttaatctgtaatcaagctacttcggcctatgcttggtccgagtggcgcatggaattctggaacatatggaacccgatcaagtgataacggaccttggggaggaggtactatgtccaacacccggtccaggattcatcaagtgattggctgggttggaatgttggttgaggtagccgttactggggaaatgcgacctggcagccgacttgagctcaagtaggtgaaaaaaggacagctctctggtgaatagttgcctgtgaaagactttattatccattgctcattaatatatactccgcaaccttgagtgttgcaattagctattaagtatcccatcgtgcccctctgaccctctaactgacgaatcaaaccacatttacctttctaaccggtagtacccttaaccctgtcggaagtagtctcgtacttgggaagctctgttcctgctgcgatattgttggtaggcaagccgtacactggaggcgggatacctggccctgccgtatcggtagggaacactacggggacgtaaatcactctctgcttcctctgagatttccgtacacagcaatctatgcaagcccaaattaaaaagatgattcgtatcgagctaagttgtggcatattgttagtgaattcgtagaaaaggctagcaaaaaaacccttacaagctgaggcattcaataatcagcatttctgacactgcatccagccatggtcgtggtttcgacgactcgccgaagtcggagagaaacagcataagaaagccaactaaaaagaatatcatgacgacaaagtcgatgaaaaaagtaaggcctgggtgtgctcttggaattcgtctggacccgttcgctgtgcctatcacctccgcgagatcgattgccaaagcaataaaagcctgaaaccaaagagtcagtatgttaacctttgtttgataaaaaaatgcggatgggtggtcattaccccaatcgtcggcacaataccagagccagctctcgggggatatttggccgcgtacatgatacacatgacgataccaccgaggtcaagcattccgcccagcgatcgttttatgcagtgcacgattccgtaaacttgggggacacgaggccttcgccgtggttcgggccatgagggatctctgggcttgccagcggctggggtaatcgcttgaggcattgtgttggctaattctggttgtggtatttgattcattatgtcggacaggtactgaaaattgcaaaggaagcggtaacgaagagcggcgtgatgagctgaatacacttaataaagtgttaagtcaagttctcgtattgatccttctagttgatgactctcgttttcatcgtggcgcagcgggtttgagccaatccatttccaggaaatcgttattcttgttttggaagctgtcccttgcacttgagttagtgtgatacctagtggatgcagccctgcaattattggcaaggcgttttttcaatcttccaactccgtggttcttatttatcatacacttgataattgttggttggactatgataattccggctggatcaactgtgtccgggcattgccttaccaattttattttactttatctgaaatatcttactttccaaaagttactagtatttgcccttggctcgtagatttaactactatgggattgtgcagggggttgggtggcatggcatactcgagtcttggctctccatacacacgtccacctcgatttcgatttagagacgctgctcgtaacacctaccctactgcctttaccaccccgtctagttatccggctagtcaaggttgatgatttccatttgccaatttcaaggttatttgaacaaggtaatcctgcaagtaaatggccaggcctggagcgtttgtttgttcgatgaatttggggcaagaaaatctgggcctgtatctccctcctttgctcatcctctctttccattccaaaggtttgtaaacagagagatcatccgagaactcggcaacatacagtgttattgtggcccgggtaggtaagaattgccaactgaaggggaaatgaggggccgaggatcagtttgaaattatgtgtaagagtgattaacatctacttgatgtgattgaactccttatcggccgcagtcgggatccccagctccagaatctccaaagtagttctcttaaactcatcagcaaactgcaagcgctcccaccatcttcgaggaatagcatccttcccgtccctcgccccaagcaacccgccagcaacagcaccgttcgtatccgtgtccttgccgatgcgaacaacgtccaccaagacctgctccagagtcctgtgatccagtacggcggcaatggcaatggtcagggtctccagaacataccccgaacaagccccggggaagaaatccttgtgcggcccgtacttggctgctctcgcgatgtcgagctttctcccgaggcggatggccctcgccacgtctccgcccgtctcgcccccctcgagctgcactgccgccgcctcggcagcgttgacggcataggtagggccggcgccaccgatgagggcggcggcacatgcgttgtaagcggcacaggcaatggtgcaacgcttgtcggcgtgcgtgatggcactgatggcctgactctcgtggaggaggcgggtgaggtccggctggaagatggccgtggggatgcagcgcatgagagagccgttgccggcagagttctgtccagtcgccactggagcgtcggggttcgcacggaagctgttgattccaatcgccgtcatgttgccgatatccttgggccgggtccccggtggattgcggcctggccagttcccctcgtaccagtcgacgaagtagtctccagcacgacgtctcacctggccggtggtgaaatgctttcccttgcgagccaagtctcggtatgccaggaggacacagcgggtcatgtcggtgtcgtcggttgcatggccaggcgaccagttgaaatgaccgccgccgatgatatcccagaggcccttgggataggacttggtgatctggctatgactctggaactcgagggttgcgcccagggagtcgccggcgtgaaggccaagcaacgctccaatggagcgggactggcgtcgcgtgtactgcttctggctcttctcaggcattgtcatttatttgactgaggggcagtggtgaaagggcaatagatgggagagagaattgatgagatctaatggctcgaagcactgccacgattcttcttgtggatgcatgattgataggcggggctactgagcatctcgaacagggaaagaagttgcgagcgagctatttttgcagcggctaggctagtcaggccctaactggacttggcggcggggaataggaggttttatgagatgcggttttggtctcttaaatccaggaatgggggcaaagaaagcatcaatggaacattgacaccgaatggatgactgaaattgatctttgaggttcaaggttgctcgctggctgggcgaggagagtggcctaggcgaggtcattcagtgggtgacatccctggcgatcagcgcctacagccctacagcttcccccacagcggatcccaggtcccaacttgctgccctgggcttattctcataaacgtagggagcagtgctgagatgaaagagaggacgctcatgtcgtaagaaatggcgacgatggcagggctgatgaaagaatgcacctgcatgaactactggagggatgccggcctatggaggagctctggctcaaggttgttccaagaaaagatgccaatcctcggcacgctgggcctgagttcgggatgttcgttggtgctgcgacaactggaggcttcttaaagtcatgggctggcgctcaattgatgaacataccagcaatgaggataacttgagcttacaatatagggtggtttaacctgatgacattacccggccgtctcctaggccggctttgagaaaagaggagttcgatgccgagccttcaagtttggggttttgcgggcctcatctctctctatctatcgtgactaaagtgatcaaatagacgaggataacggggagaacgtaccgaatgactggcagctctgcacatgttcttgactcaagaagatattctaaggggatatgatggggtcgatgcatttaagcgccgccgtctcattgacggatcttggttcttccttcgtctcaccccggaaattaacgatcgaatttaccccttttgaaagcaggtccaacacataacctacaaatcgctgtccttctccccactggctattgtttggggtatggggagatgcagtactgacttgatccatcttgccggtaagtctcctcaggctaggagactgggtgcccatgatggagtggaccaagggtgtacttgggctcagtagatgaatggaataatatgattccacgagtttcgcccccgtggaaaaatgaatgttaccacagaccctgcagaagaccatagccgcgttagtcatgtaggtatatagaagaagggatggtagcgtgatcgcctgagtaaaggagcttgctaccctctcatatttactttgacgatgaggttgaattcattcctggggctcatcgccctcgctgaaccgttatcagtggccgcttctggttctaattcctccgttccgacagctcatactcagaatgggacatatacaggcgccagtttggcaggctgggatcaagacgcatttctcggcattcctttcgcgcagccgccgattggcccccttcgattcaaactgccgcaaagctacaatgaatccttcgatgggagccgtaatgctacgcaatatggatacagctgcatgcaatatggccaaaagtttcagctttccgaggactgccttacgatcaatgtggttagaccatccgggactccaaagggtcccctaccagttctgtatgtaccgaacttcctttcaactgccatttgctaatccagtccatagagtttggatatacggaggcgggctgtatactgggagcacagctgatccccagtacaacctgtccggtattgtcaaggtcagccaggacatgggccagcctattatcgcggtcagcttcaactaccgcgttggcatctggggcttccttcagagtttcgaccttctgaccgagggctcgagcaacgctggtctgcatgaccaaaggcttgcgcttcaatggatacaagagaacattgctgcatttggcggcaatcctgagcaagtggtcgtatggggtgagagtgccggcgcccagagcatcgcatatcaaatgtttagctacgatggtcgggacgacaagctgttccgtggtgctatccttgagagcggaggagtaacgggtgcacaggtatggattcatcacttgttctagaccaactgaccattatagctgacctgggactaatagatccacgacttgagctactataatactccatacgaaaatttcacacgcagtgcaggatgctggacagcctcagataaactagcttgcttgagggccttggaccaagacacgatttacaaagctcagcagtccttaacgtggaacccaatcattgacggctactttctcactggctacccaagccaactgatgagggaggacaagttcaacccagttcccatgatcatcggtgccaacacagacgaaagctttgtcatgaacaagcccaacacggatgaagaactctttcgtgaggcatttcgatggagaaactacgctatcagtgcaccgacaatgcgaaagctgatggaattgtaccccaacgacccatgctacgcgccgccctaccacatcaccaactgcacggttcttccgagtagaggcttacagggacgccgagcagccgcaatcggttcggacatcaccatgattagcgggcgccgaaagatggcagagctgtatacatctgctggaaaggacgtattcagctaccgcttcgaccagctggcgtatggatacaatgagtgggatggggtgaagcactttgcaaacgtcgcattcagcttccagaatatatctggaaatattggtcccagcccccagtacgatacccatcttgacctggctcgggcgattggccaggcatacgtcaggtttatatacgacctcaacccgaacccgtcggataagtatgacaaacaggagcagctactgcctgaatggcctatatatgacaataatgagccgaagaacatggtgttgaacgcaactgagaatagggtcgaagatgacacatggaggaaggaggggattgcttatataaacagctacgaagtcgcaagagagctatacgcataagccgtaagagaaaagtataaattgtattcaatgttggttgtctgatcttgacctttatcctttcgccatgccctggacgtcgacgtgtgagatatcaaatgagatcaattccggatattgtggcaaacgatcaactgcaggttccaagaaacaaaagtacccgagttagcgcatacttccccaagaagcaggttattgtggagaaaaagatcaccttgtatctccttttcgtctgattttcgtattattttcgccttcttctccagaaatgacactctcttgcgaagtcgggccagagtatatggcacgagatccgctccatcgcggggagactgcgcaaatatctctaatgacgagatcccttccacttaaatctccgtgaccttcaaatagagactttgatattatcttggtaaaccattgggctggagccagggcaaatcattgacaaggaaaatagtcacatagccaatgctctatgcccaacggtagactctagccatttgttaacgggcccatctctgtcgaatgcagcttcctaactatgttttgaaactattgatcggccagctttacgtcatagacactcaagttatttgagctggaactcaaagagaacaaagtgaaacatggataggatggtggtcagcggggaattgggctataatgcagggtgtgtaccaagttgtcctaggacgagagagctggaagctgaacttactctccaaggggttcggggccgccactaccaaaagcatgtctcaatatattgacagccgggaatagttgttcctgcaattggtcaaactctgatgacatcgttcagcatcagctatgcgtacgggccgcgcgtgtctcagttgccaccgccaggaccccagtcaaggaagggccgccgaccgggcgatctccatgaagtagtcctccagagaaactgtgaaagttatttaagcaagaaacactcaaccatatccgatcggtggtagctccaggtggtagctccatctatctctatacgaactgagctgggcgtgactccatttgatgtattctccaacaaaagcagacttcgagtcccgctcgagtcgtagcaccatatgggtgcatgcagaggcgtatggttatggccccagcagcttgcttcttacgctggcccctatgctgcggaatctggcttcctctattggaccacaaacaacgaccgagtatgttggccaagggcacaccttggatctcaatacatcgccaccatgggataacgtccatgactgcgatatttccacaacccaaggcaaacagactctgggtgacctctatcatcttcagcagccgctcctcattgtcattatatgtgacgccgctttcgtagagctgctgtccgggtttggagctagaaggcttattgtgattgaccctctcatgtggttctggccagctgttcctctggcttgggcaaatgcgagcctgctgattgcagtggactatattggcgtccgagctcgagtcgacgaggcaaagatgcacaacgctgttgtggttcctccgcttgtgccgtctatcggtcgatcaacttcaaaaggcccgaggaagggcaccttggtcaacctgggtggcctgcaaactccatacatttctgtcgatgagagtatcgccttcgcgagtcttatactctcagtagtcgaacaggccatcaaagcccgaaactgccctgacgatctccccctgcatttcctgactagtcaaggagtgtgtgctgggatgcaatcagacgtggccacctcaacaaccccggacaaagcgcgtgtcctcttgtcgcaatgcaaaacggctttcctcacatcgggactttcgaacatttacgatgctgcagattgcggagctcgcgtcgtctttctgccagccaccagtaagtcgcagggggaacagccagagctcatggaacgagatcttgcctgcacctttacgcgtattgactggcatgaattgaatataacgaaggcaaagatggagtattcccagacgagcaatgccgaatgctcttctctgattcaaagccatcaaaaggcgcttgtggaggatcgcaaagcacaggaacgttttgtggaaagagttctagaatgctacgaagcggaggaagacaacgcaaaggagttgcaaattctcttctcttccttcgggcgtgatgacgggactttgattctgaaggccatcgtcgacgcaatcgcacgtgagccggatgctagaatcagtgtacaaagccgccttcaaaagtctccccagccatccatttaagttgtgtattaagtggtctctattggtgtataatataaatatagacctactttgcatgccctgttatcccgcccctgaaatcttatatatacaacttctctggttatatcgcgccttgagatctatcctgttctcgtctctctcttattctgtccgctgaagattgctacggattgttggtcttctcttcgggatggaacattaaggccaaggcagtttgggagcgcactggccattgtgccatggaggtttctttatacgtgtaattttcaggaaactcctgcttatcattttcagcgcgctgttcgagcaccagtgtattgttgtgaccacaaatgcatagcgccactgttcgagcacgccagaggggaagacatcagccgagaacgcttaccaaagtaagcagagtcatggaatattattgacgaccaatgccagggaagaaacggcttcagataagcagatgtctagaatgtcaaacagctcttagtattgtgaactcggaatgatcctggttgcagctgtcagccgccaagaagcaactgctgcgccacagaaaacaagactgatgctgatccgtgtccgcaacttcacccctttgggaagatttttgcgaattattatggacctattctagaatctccacagctctgaattgtgcttaaaactagcgattgctttgcgtcattgtgaaactgcttctcatctacccagtctctacttacgatcacgaacattgtaagcttcttcgatactcatcatatatctcgttcaaaatgacgggggttcctcggtctaaaagctgtcagaattgcagaatgaagaaaatcaaggtgtgatccgaccatcgccaagtgaaatggcccgaactgatcacggaaactcatccgtttgtcgatctagtgtgataagaattggccaacatgtaaccagtgtgcgaggtctaggaagccgtgcccagggccgacgtctcgtaccaagttcgtccattatgcccagaatggttcagatggggatatgccagagtctcctgccattggcggcatggatactcagaatcaggccggcgatgcacaacagaaaacagtgatgacgaagtacggccggtccaagaaacatggcgaagaagattcttcctttgccgttttccgtcttcaggttcctcgagccaatctcaccacgagcgccgaacggactggtgcgagacttgtgaatctttgggagcggaataagacaggcggaatggtcttacagaatagcttcataccacacttacctgcacggttgtcccggagcgcctgtcttcgcgactgcacagcactcttctgctccgtttggaatgagtatcgtcgtggtaaacctgtggagaccttgctagacactccgctgtatggcaaggctctccgtagcctacaacatgcatttcaaggacccgatgtctatacagtagagacgttgggagctatggttctcctcgaacgctcctacaccatgttcggcaacctgacaccgggtagtgtcatgggccaccaccgagcaatcgaaaccgtgctcaggaagaaaccccccctgaatttggaggacgacctggaggtggcactcgcgtttgagaactccaaccttcttgtgagttgtcccatctacattatttatttggcaactaacatttagtacagcatactgcatccctgaatgggagtagtaactacatatccgacgaaagatggagagaattgctcaccaaagtcacacttgattcaatggctgaagaagagatgcagccctttgcggacgagtctctgtacaccattgacctgttgaatacattgatagagtccgcgcattggatctcccagctccgcgccaatccccaggagagccgggatcttagagacatgacctcgaaaaggctacgggcgcattctactagaatggaatcaatgtgcttagaaagcactacaaaagcattcaatatggggtctctacgagaagtgccagatgaggattctatcactggctttaggttcgaaaccacctctgtcaagtttgcacaggtctatgctagcatgctcagcttccaaatcatcctctctcggatggtatacgagcttgaagtcatcgatgggaatgatggagaagacgaatatgcggcttacaaggcaggctgcactcaactgtggaattttgttccatacctttcaagggtagacaccattgcagcgcttcatatgatcggggtcattttgccctccctggaagccgcgaatgatatggagctggagtatattgtggatgagtgctacaaagcggatgaatcttctaagcgactgccgaaggatcgagagacactcatagcaaagtcaattttgctggcaaagtctagaacaggccggctgtgaccagacaactaatctaacggcgctggcgtcgcatgaatagaaagatgcctcgtatcaattgtagaattttaatctgtaatccatgttcatatacttcaaaaggcggacaccaaacctctaagacgagaaagcagccacggcccctgagaccaaccggcccagataattccacccactgccatccagctcaggatccccttcgcaatgaacaccctcttgacaacctggaatgttttcctttcgttgactctcgggaatggcttgtcggggacatcttgcttcaggaatttacagagtggcgcccatccttcttcagcttgaaactccagcaacgtccaattattcgctttcgcatcatccctgacgctcttgtaatacgtcgtatacgctgaagcttggaagatggtgggttcattgtagagttccttgtaatattccaccacgcgcatgttaagtcggtaccagtgacggtcaacactccaaaagaaaccaacgtagtagaaccatggcgagaaaaagtagccgaagctttcgcggcagctctgcgcccacacctcggggtttggccgtccattcaacacgagcttggcatcggggaacatctccatgaagtccttgtagaagagaatggctggcacgtcgcagaccgcactgtagccgtcaacgagcgtatgaagcatcttatggcgggtttctgtgttcttctcatagctagcgtcgatgatgagctgcagccgatcgggatggggtatgatttgtgccatatggagacacgggccgtatccgatttcctcgaatgcagcctggagtgatgaagtggccgcacgaggtaggccgagtccgatggcacgtagaggtgccttgtcagttggcgccacccgggagtcggtgatgaatcggggcattttgatgatgggtttcgtctctctttctttaatgaagttaacaagagattgagaggaagacaataagcttgccgttggctcactcctatttattagagtccaaactctcttggtggggcagcgtaagcttcagggatcgcattccagtgacgaaatttgctgacagcaaagcaataattatagccatatgtgccgagtatatcttgttgattggaaccaacagagtcgaggtcagtccatctcgcaagttgtaatacagaagtacccaacgcccgaagtaccatccagctccagcatgtccacctgtttacctgtttgcgagcaaatcctacccaaagaggagagccaagagccggggtaaatgccgtacaggggcatactgaaaagagacaagtttgacaggcaccccgtcatctcttgctcatccctcggcagtttgctgatgcccatgtctcccaaggagtgggagagggagaaataaccttagttgagccattcgtatccatgcagacaggatcaattggcgcgcctcagatatcaacatcattccggtatggccaccgctaactagccccaacccaagaatccggaggcccatcaatcgcgtcagtcgtgttgcgatccccacgttttgctccataatataagtgtctctccgcagttttggttggagcgcctaccaccctcggggttgcaatgaaccacttcgccgaatgttgcgcgtttatcctggcctacaccatggaccaattggagaaacttgggtataaaatgatgcggcaaccccattgagttcatcggaagaaggtcaagcaatcagaaaagacaaagaacgaaacaggggaaaccagcgatgtggctcaaaggacttgttgtcacggcctctgcgctcttgggttgctcgcaagccctcgagacgtatgagaggaatctgattttccagccaccctcaaattacaccgacccacgcactctctatccccgcacggtccagcttgaggatggccgtcttctggctacttgggagaactactctcctgaaccgccactggtctggtaccccgtggtagagtcctgggacggcggtctcacatgggaggaggtcggccaggtacatgatcaggtcaacaactggggcatgagataccagccattcttgtacgaattgcgacaggaccttggggacttcaaggcgggaaccgttctgtgtgctggtaacagcatcccgacagacctcagcgagaccaagatcgatgtgtacgcgtctaccgacaaagggcgtacctggaactttgtatcgagcgtcgttcgcggcgggcgcgcaatcccaaacaatgaagagacaccagtgtgggagcctgagatcctgtgagtgtttgcggcgggcgattgcgaagaaacacagcgaactgactggagtgctagtgtctatgaagataccctcatcctatactttgccgatcagagaagcgagcttcacggccaagagctaagccacaaggaaaccaaggatctgatcaactggtccgacaccgtgacggatgtgagctttgacacctatactatgcgtccaggcatgcccgttgtcgccaagctccccaacggcaaatacatctatgtctacgagtggggtggtgctcccatcttcgacaactaccgcttccctatctactatcgcttcgctgaggaccctcgcaagtttgccgaggccgaggacttctacatcaacgccaccaacaccgacatcttccccaacaacagcccttacgtggtttggacaccggttggcggcgagaatggcagtatcatcgtgagcagcaatctcaagtacgtttacattaaccgcaagctgggcgatcctgatgcttgggttgcgtacgatgttcccgagaatggtgcttataccagaaacctgagaatcttggaggaggatcctgattacttgctgatcatgggtgctggcgttctgcccccgagcaccaccaacaatgtgacggtcagtcttgtccaggtgtctgagctgctgaagaatccagttggaggatgtaagaaacggtctaggtaaacagcaatgagccggtcaacattttgttaaccgagtttcacaatacaaatcgaatttattgattgatgactgtcttcttggccgagacttcacttaatggttggcgattgataaacctattctgctagtaacgagttgcccaactaccaagaataagtaaatcaaatacggtcttctgagatccaaggcaagagtgccatacttccgtgggcggaatcaaatcaagaagtccactgggagtgaggactacccggggcccagaataacacgcagtcgtcgaagcaccgttgtgaacagcaactaaccccagtcttgaataaaaacatgcaaattcctgtagtttgcgaattgaatttggtttgacagagggtgagataatataaatcagagccaggtgcagcgcattaacagattcatgccagctctcagtcggtttcagggaaatacccagccaggatacactaccacgaatcatgcaagcgtgcgcacttttgcaataaggcaagaaaatgagcaaaagaaaataacgaattttttttttctttggctacgtacggtatcttctttaaaaagtctacttagagccgctctatcacgaatcaatcgctttgtttcgtcacaaggacctaccaccgcatgcgtaaaatatcgccaggtctagaaacctaattcgacactgccaattacaccagcagcgaatcccctcaactctaccacaacagctcaatggatgattacggtgtggtgagtgggtaacagcacccaagctcatcctctacccttctcgatccgagagaaggcatagccgctatgctatcccaaatcgcctctaatgcgttggctttcttgagtcttgtacccggcggcacgcaactggccagtagtttccatgcgagacgagaaaattcgcgacgcgacgaggagctgaagagatatactagaatccagagcacagtaaggcaatcggacgcgagggtttcaacacctggcgtggagtttacagaaggttgtaatcgacagatcaaaagtcgtttatcaacgctgccggctgagattcgcaatcagatcatggtagaagcctttggccagcgcactctgcacatgagcttggaattccagcatccttttgcccttactacccataagtcttcgcaaggacgccacacccatgccagaatccagtacttgaggccagccctgaactctcaccttaggacagacctgcccaagaagtggacttggtttggctgcgtttgtcaccaaattgcggagcccgacgagggtgagggacttggtcgtctaagatgtctaggagtgactgcagaatgtgaccccggaacggattactgcctggagggcctgggatactgcaatacatggccagtcgcatcaccaacgaaatgccggatcgggattataggttggttgctggcatgccgccaatcgtaagtctaccggcccgtttgagtctctgtatattgataccaaccccttcgtatgaactaacaagcacgttctgtccagatatcaagatgggatgcatatcctttacggaacaaataccattcgcatcgcatcaccagccttgcaccaaaatcttcaaataatattttccgaggcaacactctcgcttttaacatcttcagacctagtatgggacccggtgcagttgtctctagcttctggcttcgttggagaagacggagccaacgcatcatatgagacaagaccgccagtttttccctcgatgataaggctgcacatatcctttcgaggaggcaatgacacccaaagagacaaggccttgggagtcgattggaaatacagaaatgaataacagctttcacaaactctgaacaaccgggtgttgcctatggttgatagccttgttcaacggctggtaccgccgacaacagatgtgacgtttcaatgcccaacttggacctggtataaactcatggactcattcttagtcgagaatcagggcctgcaagctaccaaaccccatcgaggagatcttggtggactaaaatgttggcgacaaactactgccgagttatcggtttcttcagctttccctgatgaggttcggcattgcagtgggacagaggccagcgttaattatccaatttctggaatatgggttcatattattcgaaagatgttcagctaggaaataacggtaagttatcttccagttcacccctatggctctctacaataggcactaactaagcgatatttacagctatctatgatcatacacgctgtaaattgtatggccctagagaactcgagttttgtagttcctaattaatgatatcgaggctgttattatggcattgatgatcttagaagataagagtagcctcctgaaaagtgggagtggctgagagcggaatgaaacagaacgcgtctagaattatatgaccacctcgatataactgcaaatcaagatatgtattctatcccatgggtgaatcatgattacaacttcttatagattaatacagtgccaaagcacaaaaatcaaactcgactctttttaggcctaattctaagcctaagaagaacggatggcttatagactagtctcttcccttagctagcgatgcatggccattggcagctactcttgacagcatcagtaagttcaaagaaatgatgcgtgcgatcgaggaactaagaatgcccccgtattcaaagacatacaacacgatgatactgaattttcatattcaatattcatcgtgatggggcgatccggacctaggatttcggaaaacattcctttacaggtacatatacggtcgctgtgagttagcaaagttgaagtcatactaacacacgattagaagtatcgcatgacttaaattagatgttctttattgcacttatgttgcttccgacctcaacagaaagtccaaaagcaagcagctatattcctgtttctgccacctacccggtaggacatcaatcctggctaatactaactgtagtcaaggttcacatcatgctgtttaatctggtttcttggtatacttggctgagggttttttttgtagtgagttagagaagacgctgtcttcactttgactgaacctagaccctctggtgttcaatcatactcgcaatagtgctatgctgagctacacagcaaacccccaaaagagtttaacaggtggatgaagacactcacagaaaataggcggtttccatttcaacaatcttgagtccaagacagatacacgtattgctcaatatttttacagtcctgatcccggaacagcttcctcaattcagttctgtggtaggcttgttgattaaagatgacagaccaatcaatgtgtcccgattttggcagcacgagatagcgatttagtggcttccccgcaagacctgcccggaaatggcgaggtggagcatctaaaggcaccactagaaccactgaaagcttggaaagtgcgctaaaaggtgcctataacaggcctggactccacaggcgttaagggctagtcccttttcgcaggggatgggccggtgaagttagcgctgccgcccgtttctcgcttggccagatgctccccgcgcacctgcatcgcctgtgccccattgacttcgctccagttttgtgatgatcaagggatcgagtatcgccaacggccagcagtcttcagggtccatctcgaagctgcatacaagtgcattcgttactatttgttatcccttgcacacacacgccaaggcagcccagcgtctaggatgcccagatcgcagcattcccgacgagcctcgagaccatcgcagccggaaacctctccgggagacgccagcagcactggtcgtgccgcgggctcctccagccttggtagagtgaccaagagatcgactaatgcatgctctagatgccgcaggcagaagatcagatgttccgggctgatcccctgcgacgcctgtaccaagcgcaagctaccttgcgagatcaacgacagtgagcagaagattctcgtcactcgcggttatatcgaagacctgcaggccaagatcgccgcactggaggagaacaagcccgctgctgcttcggatatccttggctttggatccgatgtcgaggatgttgaggcagagacgcaatcacgtacgtatcagcctcggttcatcatacccctatcctggttgagacaattctttcatcctcttcatgacgttgactgcccttcaggtccccctagtagaaaaaaacgacgtcgctccagtccctcatcggctcaccgcgcggccagcgaaggcattgaatcttcgtcccaacaagactccctcggcggcaaccctctgaggaatccattatcatctggccaatccactttttccatatctgccgatggaaaagcatgtatgtatatcgattttctatcttcaattcaaccagacgtagaatgtataacgttaactactctctcgatgtagtttacctgggcacctcatccaattggtcgtttgcacgtcgcatactttccatgatccacgagttcattctgaagtcacctttgcctactgctgatttattatttgatggccaagcgtatgacttgggatgggagggttcagccagaatgacaccatatgattctccagctatgcctgcgctggattacgccatctacttgatcaacgctgtcaagttccactgcgcccaagtgtttcacttattcgatgagaaatcatttatgtcgtctctttacgaattctaccgaaaccagcaagccgagcacgtgaagagaagcttgtggtatgttcactttcttctcatattagcctttgggaaggccttcgtcacgaaaagaaacctcgcaaaacggcctccaggtgcggaatattttgtaaaggcatacgaactgcttccagatgtaatcactctctggcaagatccgatcgtatcatgcgagattctttgttgtgttgcactgtatctccaatctcttgataatcgcctcgcggcacacaatattgtgagtccttcgtccccaaattctagaatgggccattttgttaggcagataactaaaaacagggtgtatatagattggccaagcaatgagaattgccttgggtcagggaatgcacaccaatatgcctggcggccttcttggcgaagacgttgttgagcgatctcgccgagtctggtggactatatatgtcctagaccgtgagatgacatcccttttgggcctacctcaatcgatcaacgaccgagatatctacccagagcttccgaagtttgaagaatcgcctcatagacgtgccgcgcttgagatggaaataaggctctctcgagtaatagccaccatcaataaaggtttgccgttgattctgggccaataatcctcctgctgactttcaatgtccctagaaatctatcagcctgatggaaagctcaatagcaggtttctaacaagtacgaagcatgttcttgaagatgtagctgccgtgtccgagcagcttcaacagtcattcccacttcaactcgataatagcgtcgcgggcgtctcaaggacggctgctaatctccatctactctattatcaggttcgtaagctaaagaaatagggaaggctttaaagaaaactgacaatgctccgccacagtgtattgttctcgctactcggccgttgatcttttgcttcttacagttccgattggaatctgcggagctctgcgctaggaagttgagttcttctcagaccgtgcgcaacttgattcaaatgtgtatcgactcatctcttcaaatggtcataattctcgagagcttgcagtctcaaggccttctaggtgggtcctcttcgatcttgcctcccctcacgtttcaactcgcaaatatcattgtattcagagatactgatatgtcccaatagagtcctttcttccatttgatatccagtctttattcatctccaccgtgaatctttcggtggcacctgcaatagattctcatctcgtcgagaactatcggttttggctgcataaagcatttttcatcctcgatgagatgactgacagcggcagccatattgctagtaagcacaaagcagagctgacacgcatcatcgaactactagagagtctacctggggatcacaatttacaacaagccacgatagacttcacaggtgaagcgatggattcggggaatatttctgctgccttcgcgcaacccgaagacgccttacatggctgcatcaatgtaatgcaggctctgccaacgcctatatcgggaactgggatgatagatgacgagggaatggggcatctattggctacgtcacagatcatggacatggctaactcggttgattgcggcgatacagattggatgtctgaggctattatgacgcatggaatttggcaaggatgaaatttttgtatgtccaaaggtaatttgctgcactatagtgagcaatgttttgaaacttttcttcttcgaggaatatggcttactgcgttacctggatggggaagcgttatgattgtcttgactaatatcccagatatcctagagatgaagtacatgcatcacgttgtaactcttacacctgctaaaataatggtgtggctgcaactgcgaagtcaaggattaggcgttgaacttctatttaaccttcagagcgatctttgacttttctttcttcttctttttttgctcaacaattcagatcctaacacgcttcgttataggtgttcaagttggcctatgcctttctcttttcttacttcacacatcactggaaacttttttaggaaggtctcttgtctctcgttttagtcctagagctagtttgaaagctcactgtgtcgattctgtcagaaatacgttttgcgtggtatgaacatgaatggtttgatgactgggaaatgcacaacaaagagcgtgagcgtcgcgagagtgtacagagccaagtttcggcatcctgagttctgccttcttggaatcaaggcctatgacgtaaatcgtagggtacggcgaaaggaaacctgaagagagagcatgttgtaagaaaaactaagtaaaaccccctcgggtcctatcgtccgattggctatccaacgaaatcgtaatcagaagtggctgcagtgcttttgcttacgatctcaccgcctgaccataatgggttgatgtgtcatttgtggtgtaacattttgccttcttgtcacccttctacttacccatttatgctatacaatatatatctttaaacacaagtgttatatacaacaatatacagtgtgaatcaacattttcaggataaaacactcttttcagtataatccttgtgagttgtctcaactgttcgtacttgaatatggatcagtcggggggaaatacagtgtctgcgaagacgccagagccatcgacactcgtgtcaccagctatattttactgcatattctaagcctgcgcctccttatccgggtcatctctgccaattcgctataaaattgcgttgatagattgcaaattgactttctttgtccgtatgcctttggtcttgcactaaacgtgaccctttttcggctttcgctactagactccaaaatggtctcccaccaccagacgtacgaggtagtcgaacctcttgaccactccgaaatctcagatgatcctcctaccagccatcaaggcaacttgtcacactcaactcttctactagacggccctgacaagcgttgtgtacatgagcccaaaaagctgcgaaaaacccaatacctatcgttatttggacaaatagtactaacgatttcccctctgctttttctttgtaagtcgattagtatatggcagaagctcgagtatttcttaacatttcgatagcacttacagcggtcgcaatctccctcgataatgtgtctctctctgaaacaggctcagtaatccaacaagctatcgctctctcaccaaccgtttttcctattgtttttgcggcgatcgtgggcagattctttcgttcgttgggactatattgggcagagcgcggtgtcaaattgggggtaatagccaaatgcccgctatgccaatgtgtgcctaattaactcagatagacgctcgagcgcctcattggctcccagacccttttctctgcaatcgaaaggcaggtgctactgagaggacaatatcttttaggcatctctatcatcactatctgggcactttcgcctctcggaggccagtcggctcttcggctgcttacagtatctcctgaaatattatcgactaacactacaatccgatacttgccgattgattcatctttaaatacagtcatgacccgatccttcggatcgagaacccctagcctgacctggtcacaatggggctcaatattaatggctgctatcacaacttcttaccaataccagaattcctctcaggacttgttcggcaacgttaaaatacccagcctggactctctgccttccatcactaatgattggcggactgtggtgaactataacaggagtattaattactcgtctctattaaggattcccatcaggggtattccagccaatgggactatctctttcaatctcaccagccggtatttcgccatccaatgcaaatcctctaaacacttgagttcgtttccgagggatgatagtccgtttgcgaatacgtcttctggtccaggccctggcttctgggcatacgagttgggaggctcgtgtgtgcttcagctgggatttacaatgaggagcccagaatctaattccagcgaaacctacaatgagactgtcattcccttcaatataacaactatgaactggggaaacccattagaagacctgagatttgtggagtgctcaatggaacctcaggatgttgaatcctccgtccggtgtgttgatcgattttgtaaggtcacagcgatgaagaagcttcctttggactttggcagtatcctcacaactgttgaaatgagaacgttaggagacaagccttcatcaattttgaaccactttttaattgatagttgggccgtggatctcctttgctctaaagtccaccagtaaggtagtcaacaggatgaaatggccgccacgactctcaccacctagggcttcttcctcctcctcctcctcctccgccgcctcctcctcctccccctccactacctccaccacctccgctttgagtagagaaacctagaatctcttggacattgccagatccacctcgaacaataaggttgggagccattgttaggccagaatcgtctgatagctagatgtggtacgggcagtcagcggaggctaaatcaaggcattggcaatgtagatgaataaaagctggtaaacttactgttccttgtctgcgtttgcaatacgtcgttgattgagatatagagtgtgtgcaatttggatgtaaagtaataaaattagagttcgtgggcatgggaagctgaaaaccctaatctgaagctacatatagatttgcccgctttcctgtgcaacgcgggtgccagcccatatcaggaagctatccccttgcataacctatcacacacaatctagaccaattcttgtcacctgctgtactcggaaaagaatcagtcccatgaccctgcttgtggttgttggttgtgctaacctgtgaacagaccaggagtcaaccaaccaacaaaatctgcatgttttactgcatagtgtgagtccaattggctttttacagtaaccattagtgggctcaacaaaaatttcgggtgtacgttgtgtttcatctcaataaaaatgtcttccaaggcctagaatgtgttgaggagcactagtgcttgtgctctctttgagatatgacacgtagtaatgtcggtgagcggcttcctccgttgcgtcattggggcccaatcgtgtctgttcatcgatggcagtacagtacaaacttgtcaaaataatcttcgctccaaacatttctgtcgacggtatccttgagactttccaagatcattgaaatctcgccagctagactatctgcttcctgggaatctttctcttttaagatggtgagaagggagtatttagagcgagcggcagctccctggcatgactcgcacttctccagaactttggcggctgtgcggaagaatagtctactcaagggaaagggggaaagagcggtcagcattcacgtcgactctcgggagaattagagacgagctcggaaaagacttactctgcgcgttcgaaatcttctcgagacttcattacctctccgatcttatgttgagtgaagcctaggtagcgatgcatcggggacttctcttgacgaactctcagagaattttctaatgctgccatggcctcgtcaccgcggttcatcaagagaagagtgcatgctgtattgaaatgtacactgaatgatgggatcaggttagttatctttggtttccaaattggattctttagatatatgaaagaggtttgagactcacatggccatctccaggctgcgttcaccatgtctctctgtaacccactcagacgactttctacaccatgcaagcgattcatctaagccccccttggctcgtaacgcaattgacagattggcggcccatgtgcagcggagatgttgattatcgaacgtatcaagcaacatgttgtaagttccaacactagggtcgggcaagccatcggcgagatatgtaagggagaggtcgccatcaacaagcgccatagattggatgtcgaaaaactttggtgcctcagcctctataagcttcatcctgtgttgttctgctttttgaaaccaagcacgtccatatcccgggagattctcttcatactcgagactgccatacgtgctgtataactcggcagttaaacgtgacatgtattgagggaaatatccggggtggttacgacgctcaaccgcctgctccaagatgtcgaatccctccgttagtatctctttggcggcttggaagtagccggtctctcgcaagtacctgtaaaacatcgaacaaggtcaatcaagggctttaggcagcggagttgaaaagatggtcttaacaaataacaaaaaggtagatgacctaccatgcacatcttcggatgatctcacataacagaacggggggccggagcgtgttggaaaaacgtttatacatcttcaacagcatagagatctgggagtgaaacatggcacacttgtcccaggtttccaacatttctttgcagtcggtgtgggggaaacagccgttgagtgagaaaacaatccaatcgaaatgaagctccaaatcctcttgttttaatgactgaagaactgcctccttgatcatcctatggcagctgagacgttcggaaccagagcttttactaatcaatccttttcctgacaatgcagaaacagcgttatcgaaactattatggggttagggattcctctagtgtacttgaatataggtatatagggaactcacgttaggcgatcagggaacctatctgacagacaatctgaaagtctagggaaggtcctggctggaccattatgctcaaacctatgacggttagacaacgtgatttttttcttagcagatcacctacttggcattcatatcatggcattcgaatatttcagtcgggattccatctgggtcaagaagggcaacagtttccataagcattcgtgccagggggtcaattgaagtgagcgtcatagtccacgtgttccgaatagatctctcatatgttgaatccttccccttattaccttgaaagagcagtttagtgtcaaagtcacgataatgctgtataaagcttctgtatgacgaggatgtagtcctggcgtaagcgctgattgagttgagcgcaagaggcaggtgtccagttctgtccgcaatttctctgaccacatctagttcttctttatctaatgtgttagagtttgtggtgttcattttcaacataaacgccaaactttcttcaacagtgaataaggggatggggatgacacggcctccacaggcatgagcaatttctgggcttctcgtcgttagaattaaggatccatgcggcccctcgagccagaatttttcgaaaagccgtacgtcctccacgttgtcgtaaatagctagccaccgaaaaggactccctagtaaattatatgttcgttattattggcgtattcctgacagctgggagggagaggttatgattgaattctcttaccttttgaggagggattgttcaaaaatctacggaaatttttgatagccgcaagtttctgctccgcaacaacgggcgattcattctctaccatgcgtgcataggagtatagcgactccgtcaatttcgcttcggtttccgcgttgatccaaaagatagcatcgtactcgttcgaatacctgtgagcaaattcaagtgcaacttgggttttacctacgcctccgataccatgcaaaccagctgcgcgatgttcgttacgtggacgtccggacatgagatgggtgtgaagctcggcaaatacctcctctcgaaaatgaaaatgggggtttttcctatgctgaatgcctgtgcaagaaaactggaaggccattgtcgggtctttgtgtccttcaaggcacttctttaattctcggtgatgttcctggtagatatggaatttgaatagggtgatttcatcatcaatggccttctttaaattgaggagattcaaagaccgttgcttagcgattcgactaaaccttgaggcgcgtgggatgaagaataatagacgttctgtagaaaaaggggcggttattagacacattccaaatccaactgcaatgatgagaatctttgcataaagggaaaagttgtgtagaccctccattgggctagattcgttcagtggaaaaagcaagtacgtacttttcccctcgaggaatttgatcgcgtcttggtaatggccaatgaactcggcataaaacacaatgaggctgttctgaagtccttgtggcaagactcggctaccaaactctttcaggtagccttcgaattgcggcaaggcttgttcaaactggctgaaagtctgcccaatgaactcaagcataagctgctctcgcgacgccaacttggagggggaagacgatcgtcagcgcaacattactgggcggggtggtaactttgcataacatcatggcagatcattgacacgtacctcaatgatgatggccagtgggctccagatcagggcagagatgcccgggttcccctgagtaaagagactgatgatcgacgagaaggattcaagttgcgtgataagtttataagtccagccaaaggcttgacagtgagatcgatctgtctccagttggcgtacatgggcagcaaggctctgtggggagttgatcctgcttacccgttctgcccgtggatcgccatggttattcaggtgggccaggtgatgggcctgtgccttagtccagatcagggtcagctggtcatgcatgcctgaacattaggaaatccaatcgcaagcattggcagatttggactatcgattcgagtgcctacgtagctcgttgggggaaaaggggtagttgggcttgggaacagctttccttgcttttcatatttacaataatggtagacatacatgcttatttgacttattcctggaagcgcacgagtagctcttagtgatatttgaaaggtgcccgacgaaaacgaggcaaacgttttctgtgttggtgctagtgatcttaccggttgccttctgcaatgtggcccaagggggtaacaagtcagcttttcggtatgaaaaaagattacatgcagcaaggcatccaactttccttggctgtaggcgcatgtatgtggaggtacttgtgtggtgttatgcaaatctgataacaccttagcgctttggccgacagcccaacaagacatgcccccattagcttcctcgcctcactgaatctcattgggagtactggccctttgcccttgggggtctaataacataacttctccgcttcggtaagtcatagcacttgggggccttgggggcctttgctgatgggcttaaatcgaaaactggactatttagggagccagctaaacacctacaaaacgctgacgcggaaaagatttccatgaatctggaaccggcggagggctggctgcaagctattgctgcaactaaatcaggtatgactggggttaaattgatcggttgatatcacccgccaatagtttcattctaaaaggaagcaccgcattttccactttttttatcagaatattggggaattatctggcttttgtaagctgggggtgtccatcggaatggattggtgtggttaaggcccccccaagatacgacacagtcaagcacgcatatgctggtcgaatgatacgcaatacgtatgaagctggccaccataacgaaaaagaaacctgctgatcataagctgataaagtacctcaacttcgccacggctgacacgtccgctcagtgatctcggagcataattcataccggatgccgttgccgtaatacagacgtgtctcggttagaggcttgggaaaaaccttgtgaccgaacttgggcagatttcggagcttggatgagatacagctcgatcaaagcgagacctgatgtcattattaatttgttctggatgaagcagtgacaagtcgcaaagcagcaatgatacatcataatgtaaccagggcccctgtgatttaggggatggcggacccatccgctctttggattttacagtcattagaaaaaggaactttcatactacgaatacagctgggacaagggaagaataggggttggggggggggcgatggaatgtgccaggctcggggattcctcccgttcttgaccaacaagtagtaaccttgagggaaatgtttcatacgcctcaactggaagcaccctgcaggccgtagccaggtagaacatcggactttaacggatcaaagactcaagatcgccggtccaacaaattgaactcaaatgtaggtacattgtcaattcttcccattgttcaacccttgcctcagccagcaactcaactaacactcggagttcaagctaacagtcgttcttaggacgatgaattggacggactcttgtcatctccgcctcctccgccaccgcctccagcgccacccccctgagtagaagaggagcgcgttgatgaatcgggtttgtcctccatcagcgactatttgttcggccgggatggctgagaaaacgagaaagccaatagtcaggactcaaagtcttgcgacatgggtatggaatgctcatgtaggagacagatagaaatgatttgacatacctgcgttgtatttgcttcgtatcacttcaagggatggagtgagtgtgtgtgcaaagactatcaacaaaagcaaggagcacgaaggcaaattatatactacgaggcaaatcatatgctggaatcccgcctctgatcaacggccacgccgctattcgagcagagcctcaagcatgagccacatgcgctgtttgatattccttcggtatggaacgattggcgtgggatcgcccacgttactgaggaattcttgcctcctgatagccgtacttgcgtcacacatctttgggccgaaaggagggggcgcacaattggtctcggctgtatggacactccctgcgacatttctcttattgtggtggcacaggcctcctcagctttgccttcatttttcggtggctggccgccaaactctcagctcgcgtcatatgtaatgctgagtgtcagggatacgcgctcggggaagccagggtcggatgagagggtggtgtacaaggaagcccctttgagccccttccgagggagtcctacatattctaggagctcgctcctatagaaactactcagcgccgccaatgcgcggcgctgagtagttttggttgcagtccttgtcccggagcaaagtgcccacacgacctacgttgctgtcgtattcgaccaccctttccccaatactcatgtggcagtattcggacttccagctgcagtcatgaatggttccagccagtcaataccgcaagagtaagtagctacggccactgtccagcccactcaatcacccgaccatcccctccatccactcccacacccacacgtgtcagacggaccccaagcgctaaacccggcaattgctgcacacctagtcttattcgaaagcgactcgaggctgccatccggaaaatcgaagaagtgaaagatgtctgcgaggtaccctcagtgtcctttggtgtctcgtatggacccaatcctatcttcacccacagcattggtttacgcgacgtgaagaacggacgacctgctgatgaacatacatcctatcatatcggttcatgtgcaaaaatctttacgtccgctgcgatagggatactggttgatgaaggcaagatatcatggcaggatccagtcagaaaacatctcgatgacttcgaccccgtggaagatcgcgaaatcggaaagaaggccaccatcagagatgtctgcagacattcgaccggactggccaatcccaacgcggtccttatggcccctcatggcgctccaggtatcaagtcggaggagtatatgaagatgatcaacgcccttccgactgcgaacgagcacgggcagcgattcaatagctggtggtactacagtaatgcagcatacggtctactcggtttgatcgtgaaggctgctgctaaggtggactttgctacgttccttcgaacccgtatatgcaaccccctcggcctgaaagatacccttctctccgagcatgacgtgacaaataacaataatctggctcatccatatgtcaaaagagatggtgaatggcataaaataaataatggcctcacctctgaggggcacagccatacacttccgtttcttggcatacgctcctccgtgagtgacatgttgctgtttggaggtgccgtgatgcatcgctacgcaaaggagcagaagagccaatctgagaagaacgagacatcccaacctggtgtctcttggtccgataggctctggggtcttggacaggctttaggattaattgcgggatctaaagagaatcccctgaggcagatttcttacatctggaagtcgcattggactcggccttgtgacgatggcttcgataataagacggcctacatgctcggctggcttcgcaccaccatgccaacagctgccctgccgcttctctcatataacttctacccgacaaagaaggagtacattatcggaagagaatccccgcctcaagtgttgtacggccactctggatgcaccaatggctctgtcgccaccatgtacgtgataccgcaatctggttttgcagtggtagccttgagtaatgcagcagatgccggcgacgcatcgaacagcactgttcagattctgctgcaagctatttacgacttgggccccaaggttgatctcatcctctcgctcaaagactccagggaaatgaaactgaagcagcacgaagacatgatcagtgattggaagaggcacagagatgtaggtaaatacaattgcgatgctgaggagctcgttggaacctactatggcctgggggcatctatcatcgacatcaaggagagcaacaaatccgactcaggcctggcagttgtcttcggccaccaaaccgcgtccatgtgtcaactggacagatttaatcgagactcgcttagcttccttcccatggatcacaaggaaattttggagagagctatgattgattgggactactggactgttggcgtttttcgatttgttagggaggacgaaactcaaccgaacagcccgatcgttgggctaagatggaaatgggaccaatatgaggattcaacactctgggtgaaacaaaccgacaaagacacgatgaccgacgaccagtataacgctgtcgccaagaagcatggaaagtttttgaaggacccttgagccgaacttgttcctaccacaaatggcaatggtcactgcaatggtaacagcaactgcaacggcatggagaaagttggagatcatgttacctatcagacggctgatgcaactacaactgctgcttgaagctttcgggcttagcttcaatttcagaggtgaaaaaaagtagaacatgagttttggcatggcccggtcacttggtcgtggagttgggatgtaagaaaagtatgcttcttttattatttgctagaataaaattaaggtgacggagaatcaatattgccctaatgggtattaataatactttatagacgatacgatagaggaaatctcaaagctatcttggcccaacgatcgggctgttcggttgagtttcgtcctccctcacaaaaccgaaaactgccaaaatgctacagctaaacaaccatattgttgtaaaggtcgcaggatggtccaaataagattagtgagacacaactatcaaggtcataaaatgttggcgagatatatgtttctcaagtatgcccactctgcagagagccgtgccatcaaggttagttttatctcatatgtcttacagagctcgtttttgtttagaggatatcagaatgaagagcaagaaagcactagtcgggtctcgttgcatcaaagacgccaaggagctactggtactcactgagttggttgcctcgagcttggtgtgttgaagtgttgagattggtgtaagtcgagtgcacgaaggaagccaggcgagatatatatacatgtatatatattgagggtatgctaaatggtcattggacgggcggctcgtcccgacggcaagtatgtcatcggtatgacacagttttccttccgaatgaatgcagccttgggctagcaaagcttatttttgcatcagtattcactgtgttgaatgtcggggatggcatcttctaatgttgtttatgacttgacactcgaactcgcccgttcagagtataacagaatgaagagggaaaaagcactaaacaggtctcgttgcattaaatacttcgtttcatcaattatcaaatacggctcttcaatctatgtttttcctctgaagggggtgatcaagcatcgaaaatacattgcatgatgattatcatacttgacatctactgggggactaatgattaagtgacctcagaataaatattaatcaaaaatacatcacacatccctggcatgatctaacggacatgaatatctctctgcactcgaatctgcttcgctggcagtggatcaagaggaacatggtccgaatccccgctggtatcgttctcatgagtcgcccaacccgctgcagagctatgataccgttcctctgtcgtattgtcaacccacgggcgtccttgatttgcgctttggtgatctgacattttgtagccgttggaggcattatttctatttctcatggacccgtaccacgacctgcttccggaactgaggttggcgcttcctgagaatagcggaccgagcgttggaaggcacgcgcagatgatagctgttccgagttggatcgtagaccataagagggtcttggcggcgttgactaagttgagaacatacatgttagggcctggttagccagtatggtaggagagaactcacagtttagcaggacatcgggcggttgccaaatgacggtcaatctcacaatgctaaacacacagacgctacaataatgtcagtgagaactatccacccgtctgcgtttagagctcactcacccagcgccgagtagaaacattcccagaacagaccacttcttgaccttactcagtctaagtgaaccgacaacaaatgccggaatgcagaggataatgacatcgatgaccaagttggtcatttcgacggcgagaagaacgataggcgaggaaatacagagctctatttccgtcgggcgagtccagagcgcatcgatcggcttgcattggaagacgatgagcaagatgaaggcgatgaaccaggcaacgctcaaagccgtcgtaccgataattaatttcttctggaggtcgttgacaccaaataaggtccagtaaaacgcgaggatgctgagctttaccaatgtgatgctggtcgtgaagagcacctcggcaatccaagccatctagaagttaacctcttagcataactggctcaaaataatgtacttgacgtccttgggcggctactaccttcaaaaagtcgagggattcttccagcggaatttcaggagacccaagaaacattgtcccgaatgctttcaacttagatacgcggaagatgtctgccctcaagtcagtatatttcctgattaaagctcattcatcacggaatatctcacggttaatcaacagcgcgcaatatccgacaaaaaccacgtaacatgcgatgcagagccaatctgattggaacaacttctggccgagactcattcgcagcaagagcctcaaaataatcgtgattgcgcagaggatgatcatggtcacgcagaccgcgaaattctcacgggcatcttgagtcaggcttgtcatcgtgacctgtgaagccgctcgcgaccagcgcgtatctcgaacgtatcgtcccgttcgcgtcgagtcaagtccaaatcacgacttcggatcgaagtaataaatcccaaactagcctctcgaaatccccctcctctcggatatattatcgttgccacgtcggctggttcgtgttcaagttgttgccttcgagatcggattacccacttgcgaataggatttcgccaatgcgagaaaagatgaaaaagcagaagaaaagaagggaaccccagactccaggaccaattcccctcttcacatttccagaaggcaaacggtggcccacaccgggtgttaataatatggcccttaggaagtgatggcgcggaagcttggacttccataatccccaaaagacctgcaggattccggatgtaaccattcctggacccggtggtcagggtctgggattgatcatgccatccgatgtggatgaaaacgtaatgccggcatcgcgcttcagccgcgcgactgggtcaagtgggtttatttgtcctctgccctctgagaaatttcaggtgggttccgtgggagtttccatgatgggttttcgccgaaattttctgctttttatttcttctacgaggccaccgtccgagataccctatgagaaggatcctcttattcattctatgtgagactcgtcagccaagacttggtgcatactacctagggctagaatatcagacgtacattagctcgtggtgtagagtctggctttagctggtctgactctcgccgttgactggaaggcttccgaaggatgagggatgctccacggatattgtgccggagatgtcttgatacggacgagaccccagttatctcagcactagccaccgtcgtagctgaccaaagatggacagaccctgaacaacacgcaagtcccaagggtgtgcataagtccagtcctactatcctcttgctaacaaaatcgtgcacgagcctgggatcgcgtgtatgcctgcatgaggaaggcttgatttcatccatgcatcaaacgcgccggagatggcggttccctcctttaacatgcgaggcgggatgaaccatcagccttgaagcacagaatacctcgataccgaataacgacgcggcgactgttttggcccgcacttgtgcctgctagtcgcactagtttccccttgaaggtgagttctcctacgctcgggaatgattcatgatgagcaagggttggcggtgcgccttactagcgattttgtataaatggagatcgaaactattaggagttggatgtacccaccctcgattcatcacaaaattgattttcacacagtcccctcagtactcgctttgcttaaaggaaagaaatccgctgaagaaaactttacaatcctacgaatccactgcagggttgactgatccttcgctacagtaaccaggccttcattatagagcaggtttatattcggttcctgtttcaatctctgtccagtcctccattctcataatggtgttcccaattttccatcccactttatcctagtccgtgtccaccaatccccgtttcatccatttctcgacggatcccccctgactgaaatgaagacagaactgcataatactagaacgtgtggagctttgttcctaggcactggagccgtgataacttgtctgtgatatgacaatccttctgtgtgggagaggatgccattgatctggaatcaggctaggataggctcgggggggaaaattgagtgatatcctgtgccgcgtctgggatcgtcttcctgtttattcttgagtttaagtgcctgtattttgatatgcatcaagcgatatgaaggttctgtcaagcttcttgccgcataagctttcgagtagagaccaaataaaaagagcgagtccagcatcagcaaaagcacgctgattcctaccggaggctataaggtggtcccgtagagcttatttgatcaggggtaggtaatgaacagatatctgggtatttcgatattgagaagaaccccaatatagagcccagggccatgtttaccaaagatcatatgcccctgccatccccacagccgtgcctgtgtggtgtcatttcagcacctttgcacttgcatataactcaaggcaacccccaaactgaggggacaatgtacgatggccgttcggagttgttctactgaattccggcgagtgaaatctacgaaaccgtacttgtctttacggaattttcgcctcatggcgagaaatccatcgtttccagtaaaggcttgccatttcacgggtcgattattcaacgctaaaatgaacatcacatttccaacatgctggaacggaggcaagtcggccgctagatgtccatttctcaacttgaagaagctgagaacaatagacttccggaacatatcttgtaccttgagagctgccgcatccaatgagtcacgcacccatactcggtcattcgcaagccctaacttggccatgaaaagatgccgagcaacacttgacaaagcaacctttcgattttctcccctgcatcatttgacacgaagctcgaccagaagggttttatggacttaccactctagctagctgttaaggttctttgtccatgtagtgtctacgcaccaatactgctaaagattctatcagctaaccagagaacgtgaccaaaaattagaactatcttcaggctaagtcactgcgccaatatgtgacgaatgtagattatgaggactgaaaaaaagtccttttgtgcaagtacaagtatagttgagatgcgtttaaaaagtgacatgcttctaatttactagccttgaaggttgtgtactctaacctctgaaggccctggtaaacgcgacagaccttcatccccccggaacagggactactagtagacattggaagcttatgtacgtgactaggaagaaatacacattttcagattggcaaaggacacttttgcatcatttcgcgaacaacatgcttaagggaactacgtgtatggctaccctatagagtataattgcaagcacggagaacagcaaagcagaccaaatgctcatttatactgcgtaaatgcccatagagcttgagggtgtatgtccttaataaggtgtagctgcattagcatgccgagtatattgttcttcctaatatgtaagtactttagccaatactctgttgacacaaagaagactctgttatcccgaactctttcacagataaacccagtcttcacacaacatgatcctgaaagtcccgatttcaggtccccatgggcctttcttgacgcaagacgtccacatagaggtaaacggttttcggttcgggcgcatccgctcatggttgccgcgccgaaacattctggccacgacccagagcttgcctcgagggaaccttcagaatactccttccacctagtctcatcaagagatgttttgttgtttctttggaggctcactcagctgctctcctttttacttaattttagcaaattttagtaactacattattgcactgtatttcaacgaagtcaaggcaattcatggctatcatattcgtgagaagaacactgcaataaataagccgctcatgctgcgtaatatttttaggcccgtgcactgtggccaccgagataagaaccgaccggtccctctatcgactgctaagtcctgttgttgacatatgtaaaggacttatttatagattaattgtgaaaaaactcatgttggtttttaggaagatgtttcaagccagtcgacttgtcgatgcatgttgtgtgttatgctaaggtcgccaaagggtttcgcatttcaagtcaagtttatacagtttgacaaatgtcggcgagatagatattaagacctgtcaagtgacaacgctgactcaacaagtattggccgaagttgatagatctgccgagaaggagaattgcgaaattctaagatggcttacatgacgagttctacatttcaccacttggttggcggtagatgcatggaatttgccaagccggatgatggattatcacagactaagatgattgaaaccaaaaaaaaacgtaatcttatatttatttaattatctaagcgtcaagggccgggtcaaaacctggtacaccatttccagcagcagctctaagcgaatcggtgaactcatcatccaacttggggccaactccaccattccacgtcgagagcatcttgttgcggaggtcggtgctaggccagttattccagccaaccagagggctggtatagaaagagccaaaggggttctcagggtgggcaatgtcatcgctgttagcgaagcgaaagcagtgagttgcagcaccatccttgtgatacacagcctgtacccggctcccggaaagggggacgtcgtttctggcgttctcgtactttccatggcatgagggtgcaacgcgaacgacctggtcgcccttggcaaagacaacctatgtcggagttagtgccaatcactttggaagataagtcgtctgagaaaatggagaagcttacaatgttctcccagtcaaatctgtgaccacctaggaagcttcctccaatggcctggtccttctcaaagaagtactcgtacatgatggcgcaatatccgttgttgcagcgctttcgagaataggcattgctgttctggagctgaggagggtcgcggcacccgccctggggagtaccagttgcaccctttccagggttggttgtgccatcaggggaaatagcagccgtgttgtagcagccgtcagagtcaaagtctagcagcggctggaacttagtctcagtggcatcggcacttccaggcagagctgcgatgatgtcacgtttggcgttgtaggtgggctgggcttggacgattgccagggcaccaaggatagcgacaagagaggaatgcatgttgagttggctgagttgcttcgcgctttacaggagagatgaagtcttaacaagagatgagcggttgaggagctactaggcctttgtactctggttctgacagcctggtagttgggagaaatgcgtgggtctaggactcgtcttatagttgccgagtttgagttactgacgaagtggccaccctagaagtgacatttattgttggaggcacagccttggctgagagcatgatagtcaacccaaaatccctcgttaaggagcttcgtctcaaagcagaaagtcgtgacagggaccagtccgttccaggaaggacgatgttgccggcagctctgtggaaaccacagcggctgaaaacagcatgtcattttccccagacccataaaaggattcactcagaagaattactaaagagatcgacatgttgccagtgccgtttactgcccattgaccctgtacacgtggttatggcagtgggggcctaagaaagacggtgccggcagataaggcttagaagtggttcctaacccccaaaagggccttgaaaggcgtttgcttccgtgatcgccagaaaaagaccagtaggcagacgaatttggggcatgctgtattttccaatgattaattgtgccgtggttgttccagctggcgcggctctagaccagcatgaaacaagtggctgggccaatgcaacgtgggtctgaccacatgctctgacactcctcgtccattgagggacacaactcgcgagtagctcgatctgataaatagcgtgatgaatagtgtgaaattgagagcatccatgttatggctggttgaacagaggcggaggcctgcgaggagtatgcgctcaatcccttgtttaaggagcaacactgaaatcttggccgacgcaacatgttaaatccattggatctagggcaccattaaatcagtcactggacgtctcctgccttgtttattgacgcccattttcaaggcgccttgcctcatgtgccgctggcctatacaccaccccgtccgctttcagaggtatttttgtcccggtcctttgtaagaagcccaaactcgctttgcgtaaatgcggtttcaaaagacttggcgcctggttgatcagagaaatgattaaggtcatttccttcgaattgttaaggcacagtgccttggaatcaatgacaaattcgactgtaagcattgcaaaacctcttccctgactaccacgtgataattgtgagaccaccgctttggcaatttgtgtcgagttcaagatagacggcctgtagtgtccagtttgatcggaatcttactttgcaagccccatttcatgtatcgccacaccagagcccccatcgcttcatacgtgcggatgatctccggattcccgtgctcccctcggagggcctcgcactctttttccagaacgacagtcgtcatctggaaagcggtggtgatgaaaaagggcgcaagtcttcggtttgcaacgttctctgcaaacgaaatggcccgaagaacattctccgcatacttgataagttgagcgcggtgacgatggatctccttttcaggattggtcggtataaattgtgagttgatggccatcatcatcgagactatatccgtaagctgcaggtgtaatgatatgacaatggtccagtacagcgtgaaggcttgatactcgtgcattgagtggaagtgaaggagggtgtcaaataatgagtgtaagtcctgttcaaacatgtgccaaaacttcgaattatcctttgcctcctcttggtcaccgtttgaattcgattgacactcggtgattgaaacctcatagaccactgtttgccatatcgtagctgataattctgtttggtttaacagggtctccgcttcatgatacagctttaataatgctcgactaagctcactgtcgcctacctcgccagtctgaagatgttgagcgaccagctggtcatatcgacttatcagactcgccaacgttgggagagaatccatcaaagaatccagaaaggtataaatctcagttccccaggatggaatcagatcgtcgctggtgtatatcgttgtttttgcctcagtaagccaggcagaacggatggtggacctctttcgcgattcgtagggcgtgaggctacccagttgtctagaagagagtatttgcaatgactagattgataaatggttagtcttttactatctacaaggaaaatagaataaaataactcacaatcattaaacgcgaagcggctataagctgcttatttgttttcgagtaggggtggtcctcccctcttagagcaatggcgtcagacaaagcgcggatatggctttgccagtttgtagatagagggcacattttgagctaaataaaagaatcaacgatattaacgatggaactttctcatttgggcaccaaggggtagaatgcatacttcccagaaagccatgacaacgcagaagaatgcgaaatgctgccaattctcctcgcatacgccatcaagggtgggatcgtctgcccctaaagctgagatggacgatgacattgatttcaaggcaagcccgtatttatggaaactttgctgtacagatgctgcgtcgcccatggctctgccgaaatgcccttgagcaagagcattgacagccaataccgctggcgtactgagggatgcgctcgcaccagcattgatagttccataagaatcaacagagaagtatgtgcggaacaagctggccatgaaatgcggggttgtgatgaagttcgttgcaaactcagtcatgaagaaggccgtgctgagttgggttctgtcaattgacgggctccggtacagaggtagagattccataatggagggatcgggtccaacaagagcccgattccccgagtcatttataccttctcggttggtacaggcagtcgatttatcccgaggctttgagggcttattgcgtcccgccttggatacgccaggagctcgccatccgtcattcaggaacacaaagtcgtccctgcggtatcccctacaaatctgtttccggccttcgcaagctctgcaagtaggtcttcggccatcttcacactggaaattagccggtaaagatatgaaatggtaaagaggcgaaaacctaccacaacgtgactttcgggcaacgcaggtgaggcagcctttggaacgaggcacggaagggagtgacgtgtccttcccacatacaggcatactttctgagacaagaatgctatcctagaagcccctggaagtgaacccccgattattctagcagaaaaacaagatgcagaagggtagtcattggagatggacggaactgggaactggctcagagaaaccacaaacgagccttaactcaatcaggaagggaatgctatccctgtcaatgacccatcttagactcagcaccaagttgccgattggatagattcaagaattagctccacacaatactctggcgggaggtttgaatagcttccagaacacgaaatgagttgggtgagattggcctggttgatgcaattatttacaatcgttccgaaagtccgttgcttgtcgattttgggtaagaaacgcgatccacgtcataatatgcccctgaaaatttgttaaatacatcggaaattatttcctgaggctcagcttcagtacctacgtataagagacttctcaatccgtcctgtcctgttggttcggttgaagtgtcctaaatatcgccaaaatatcaaaaacaccctggaaatcatgtcgaacaatcaatctcaaagtgaggacgtattagcttcggctatgtcatctgagaaacatcctccaccaggagagttttcctcctctaaagccccagagaaagtctcagaagccgctactggtcagaatcaagaggcagtcccccgagaaaagacacccccaatcctcagtttgatattgattggtgccgccttgtggttttccatctttttgatcactctggtaagaccaggatcccggaacggctcccatcctattccacttggggaaaatatccactaacagcttcgtgcaggacgggactatcgtggccaatgctatcccaacaattaccgacgagtttcataagatatcagatgtaggatggtatgggagtggtatgtaaacagagaatgacgcagtgtcgcagtgccgtcttaacattttctagcgtatctcctcactcaggctgcattccaacttctatacggcaagatctatgccaaattttcgatcaaatacaccttcatcgctgcgattttcctcttcgaactagggtccctagtatgtgccctcgcacccaacagtactgccctgatcatcgggcgtgctgtttctggcctcggcggcgcaggtgtcacctcgggaagcatgaccatcatcgcgtactccgtccccttacgtcttcgccctctgtttatcgcatctttcggcatcgtgttcgccgtatcgtctgtctgtggccctctactaggcggagtcttcactagcaagctaacctggcgatggtgcttctacataaacctcccttttggaggtttcaccattttggcgattcttcttgtcctcaaggaaccaaaacgaccagagttggattcgatttctcttagaaagaaacttcaaagtattgatttcctagggacgctgttgctcgttcccgccatcgtttgccttcttctggccctgcagtggggtggatcaaaatattcgtggagcaacggtcgtatcatcgccttactggttcttttcggtactttgtctatcgccttcatcgcattccagcactggaagggagaagaggccaccctggttcttcgtcttttggccggtaggagcgtgctggcagctgcctggtacggtttctgcaacggaggtgccatgacactgcttgtgtactacattcccttttggcaccaagttattcatggtgtgagtgctgtggactcgggaatcagactcctcccttttatgatcggggtcgtgctcacggtgatgctagccggagtgatcgtgaccaaatttggctattgtaagttggaaaagcctgtaattactgagaattactaacctattctagatacaatcttcttaattctatcatctatcatcacgcccattggagagggcttgttgacaacatggaatgtggacacgaggttctcagaatgggtcggctaccaagcattgatcggattggggatcggcttaggccagcaacagccactcgttgcgatccagaatgtcgtaccaaaggcagagattgcatcggggacggccatagtcatgctggttcaactcctgagcggctccatctttgtctctgttgggcaagcagtcttgcagaacaaattggtggaaattttggccaaggcgttcagcgaccgtagcgacttcgatccatttcagatcgccaacgctggagccacggacgtattgtcaatcgtcccggctgacgacttgccagcggttttggaagcatataacagcgctctggtgcaggtatacacggtcgccctcgtgctgtcggcgctgaccatctttggcagcgtggctatggagtggaagagtgtcaagaaagaggcagataagccctcagaggagggctcgtcaggtaaatgagcatgccacaccctctgtaaagttgtggtgacctagaaagctcgctcacggacgcctgtttcaacctctcgcttggcccgcaatgggatattcaacccccaaggatttcaacataattaatagacgctagaatcgaattgttaagagaaaatatttcagtcatcatactgtagtgcgagattgtggttccgtttgcttgggatcggagttaggcgaccagtcactaataatgccgcgtgctaggggagatttcggggaacgttcagcagggtcggagcgttatgcgcccgccagctccaccatttgacagaacccgtaatagccgtgacagtaatagtaatgcagtgtcaaattcaatcaggtacttggttcatagaaatactcactcattgaaccccttcagcttagtacaaatagatcatattacctttaaggaagaacgcaccctccacaagtcagcctgagccggaggactgagctgggctgctttagaaggcggaggaactcagctccgtggctggtacgcattccctaactccagaagcaccggtagatcaatcccgcggaattgggcctaacctctagtccgtccatattaacaccgtctacggagatagcagcccagctaagagatattgaatacttattaaagaacaagccagccgtggactttaaaattttaatccaacttgcatcagtcaattaagcaatcatattaatacctaaagcaactcaaacaatcacatctaccacaaccgaaaactgaaaatggcaactaaagcgatcgtggtcggaggaaccagcggcatcggctacgcaatggcctgtcgagtggctgctcaggccggttcagcaaaagtcatcatcagcggtcgtacaaagcccaagcacatcccacatcccaacatggactttcgaccgctggatgcgacgtccatgtaccagatcaagaaatacacagacgccttcaagtcttcccaaaaccagaaactggacctgctcatcatgacccaaggcatcatgactaccgcggggagaactgagacgccagagggcattgaccggaaaatggcactgcactactacggcaaacagctcctcattcgggaacttcttcctgtgctcaaggaagatggaaaagtcatcattgtgtttgatggcaagtttggaaacccaaacaagttgaattgggacgacctggacctgaaatcgaactttggcctcagcacctcagccaaccattgcatggtaatgaatgatattatgatccagcatttcgccgcccagcagcaagagcagggcgttggaaggcggcatttcatacatgcctggcccggagctgtcaacacaagtctgctaagggaactcccgcgattcattcagccgctcgcgaaggccgcgaatcacttgtttacagtgcctcctgagacttgcgcagagtatcttctcaacggggtttccgaacgtgtttccgatggcgagaaacaaggcagattttgggacaatattgacaataaggggcgtttgattgataataagacggtttggaccaaggagcaaatgaacgcagtagcggctcacacttggggacttattgacagcgggattcagtcttctcaacattaagttagttttatcatctcaattaattctatgtaggaatatgatacgggacgatagttcgtctacctattgatcatgatacatccttctatcccatctgctctattaatagaagacgaggtttactgtcatggatgacatacatgttacctgcaaagtcagaggctcacaactacttcatgcactagcaattgacattcaatggacactttcaaatttatacggggatcacggtttgattcgttcctagtattaactcttagcataagtagactagagcctgttaatgaaaaatcaccaaggatggaacccgcaggaatcggtccaactttctgattgccgtacccaaggctgggcgggatagtcagtttgctatgagagaaatcagtaaagaaagaccatgccacacgagcgctgtccactaaccgcttctcgcctacaaccatgcccgagatgccttgatcccatctttttggattggttagttctcgatgatttggaggcatttgggagacttgggggctacagacccttgaatggcttgcccagcgccgagcttgaaggccaaaggcttgctcctgtcatgacctgcacacattttcatcagtattctccccccaaagaacataagccgtgcttcttctgggtagtagttttgctttgacatcacatactggcatcaaatttctccccgttcgaggcgagggcaccccgataatggacagacacgttgtcgccagccttggcttctcgatcgccgttgcccttctgagtgacttcgatttggagcgacatcgtgaaatgagaatgtccgtggaaatagttgattgttgtggaagagagggcggggtagaatcatggtggtatgaagaggggaaaaccctcagggcagccgcggggtcatcgcagggtcaatatgaataatacgcgcatagggaaagatcgacgagtccgattagtcaagaagaaggcgcattcccaatctttgcgtggcgccacaggctccaatattgaactcaaatataccgcgaactcccgaaccaggaaactcatcccacacccgccgcatctggagggcgagaggtggctaggggatgattttgcattccattccacgaaccaatcgaaaccttgagcctgaagaactctagttggcttacaattgcgaacaatgctagctgacgatcctattccatttgtggctccattatccgagtctccggtggtgcgtagaccgtaagtcagcttagttttcctaaagtggtatacgaggtctgcttatgtaggggggcattgatacaaataccgcattcaagataccacctattgctcctcgtaacccctttttagacaattttcattcatacagtagtcaggctgcatttacaacatggcaggctcaggcaaatttggagtattctcgttgttgtttccaagtacgccggctggccccggtgtggacaacaggggcagggcgatccggcagcgacgcttccatgctaagtctcgacaggggtgcgtcacctgcaaatctcgcaaagttaaggtgcgtcagttcaaaaaaagtcgattctttcgtatagctttcacgctgtactcgtctcttttgattggaacgggtgttggctgacgcagtgcattgcagtgtgatgagcgtcgaccagcgtgccagaggtgctccaaaagaggcttgacatgtgagttcggctgctctcctgtggagaaagatagatctgctggcctaggtcaccatagtcaagaggctctcgtgaccgagcgtgatcgatgcaacaacaatgaacgccaaaacctaccattgtccagcgtggccagtcgacgtttgctttcccgaacaggagagcttggcgcccctagctttgacttcgagagtctacagctgatgcatcattttgaacatttcacttctgagactctactgtttgataagccattttgggaaaagcacatcctgccccttgctctacaggtttgtagacttgtctgtgtgttccaagcctcgatgctgaccctgggatagcatgagtatcttatgcacgccatcatgactatcagcgcatctcacctactttatctacagcccaaagtccgtcagcacaataaagcagcagcactgcacctagatagcgcattatcggggtttagagcaagtctgagtggcctatatctaccacaggcccaatatgatgtcgtgatcgcatgtggtttcatcctcctctactatgcctggtcggtgccattcttcaatacttctgatgaagactcgacaacgatcgaatcggatgggctgttatggtttgcagcaggcatcaagactgtcattgtaactatatacaaattgagacccaaggacagtatgttccaggcatacttcgaagcagaacctgtcaagtctttctacgagtggtccgaacagaccgacttttcgtacgactttggacaaaagttcctcgaccagtcgcaggctccagttagacatccgggccttgcctgtgtttccggctgcggaagtgtcaatgccgcggagcggctcggccctgtcttccatgcactggatgccatcagacaaggcgaagacctctctgtcataatgccagctgtcatgacatacatgcttatgtggccctcgaaagctatgcaagacttccaagaagagatcaaaaggggggatcacagggcgttggttaccatgcttagtttttacgcgagtagttggacactcctatcggggagggcctggtgggcctatcatcgctcaaaagtcatgtgcactgaaattttagaccgtctcagcaccatggggtcgagtgtctgggatgaaaatattctgaatataacggaatactttggatttggtaaaaacgtggatgggacctgggagatagggggctcaaatcaaatcatgtggccagcttagttattcagaaaattgaccatgtcttatcttggaaatactggcagcggggctttagactcgtagttactagattgatcatacactgcgtacgcttctcattatacaaatcgaagatctcgaattgtgggcttataagactgtactaggggtaagctcgtatacccaaaacggtttcgaacaaacctcacttcgtatatccgaatgggttaactgctacgtcgcccccacaactatagacgcatataagggccaaattccccagcgatgagtcgtctgtcaaattcagaagattcagatttacacacagcaggaatcaacttcttccttcttatcactctcaacttacagccgactattatcgttgcaaaatggcaaacttgatgacggtagcaccaaagcctaaaagcctgctaggctatcatcggcagctcgccccaaatgccgccgttaaagtcagcccgctttgcctcggaactatgggcttcggcacagagttcaaagatatgatgggggcatgcgataaggaagcctcttttgaacttcttgattacttctacgacaatggaggaaacttcattgacacgtatgattggagccctgaaacacactcatttgttacgtcactgactatttgggctccagtgcaaatgtttaccagaatggagaatcggagaagattgttggcgattggatgagagagcgtggcaaccgtgatgaaatcgtccttgctacaaagtatacttcgtcttaccagctgtttaactcaaaggtcggcattcagtccaactttgggggcaacaacaagaagagcatgcgttcggcctttgaatccagcttggctagacttcagacttcctacattgactttgtaagtctgttacctattgtggcaaacatgttgtgcaaggtccggcggctcatttttcaatctgagcagttttacgtccatacctgggacttcaccactagcatcccagagctcatgcatcctcttcacgatctcgtttcatccggcaaggtgctatatcttggcgtctcaaatacacccgcatggatagtgtccatggccaatgagtacgcgcgacagaagggactcaccccgttctctgtttaccaaggacagtggtccctagccgaacgagacatcgaacgtgacattcttcccatgtgcaatgatcagggcatggcgcttatcccgtatggcgtcttgggatccggatcattccggactactgctcaacgacaggcagagcgagagaatcccgaggcaaagagagaaggccgcaacatagcaatgactgacaagccagagaaagccatcgttgcagatgctctggagaaaattgcctcggagagaggtaccagcatcaccagcgttgctctgtcgtgggctagaaccaaaggcccttacattttccctgtggtgggtggacgcaagattgagcacttgaggggtagtatcgaggccttggggcttgaactcacaaaggaggagattgccgttattgagaaggctgtcccgtttgactttgggtatccgcagacgatcctcggcggtcctggaggagcgacaaaaccaggcgatgtctggatgactcgtcggttcggcacgtttgactgggtggctccccccgagccaccgaagcagcatatcaattgaataggctacgtagtatatagacgctttctcctttcttttgctagaagacatgtatcatgtatccgttaagattagctgctaggaagcatagcaacagccaccgtatagtacacaggatgagtagtggttatagagtagagtttcaagtttagaacgaagagattacctacaactgagcagaactgggatcgcctgagctgaaagcggacaaggaaattatcgggccagctaaactcataagaattgtgatacgacataggtgcgttctcaagacgttatatgcataaaatctcccacgacgaattttgacataccagttagggtgtagttactattcgatcccctcaagtagtagccattacacagctgcatgatcactgcttagttagaggatttgaaattaattttgttatattatttctttattatatcaccccttcgaccaaacaggtgatggaggcgacggagtgtgttccagaggcggtagacccatactgctcactgatgataccgttcttgtgctaggtctagatagcgtagatagtctagatactcgctttgaaccctcgtcgtccctcaaccggctcccaactggaaccgagaatctagcatgtcttgttgaagcgcgttccgacatgccagacgctcttgtgtagctcccaccagacatgcttccccatcctcgtccaccgccgctcatctcaggcccgcctgatacggatgatggcaagtgagtgctgcccattctttcagcttcttcctcagggccatcctctctcgcagccgccgccccagctgctcccccacaacatgccgcgaaccacccagcccttaaggcgaagaaggctaggccggcgagaatcaaggcgccagcaatcgaaccgatgactgctccaacaattgcacccgttgaaagagagctgccgtgaccacttccgcctgaggcggcatcggcggtacagtacccgccggacgcggatgcggcatgcactgaggaaaagtagctctgtgcctggctgggaagaccgctgtaccagcccggtgtggtatatacagaatcgcgatcggccgagaggaagcacgcagaggcagggtcggtctgtgctacggctgggacagcggtttggataatgctcagaatgtcgccggtggctaaggtcgaatcgcctgtcgtatcggagccggtcgctgtgcgtgtgccagaagatgcgctcgtcgtcgaagttttcgaggtggttattggtcctgacgaagaggaactcgtggctgtcattgatccgctgctcgtctttccaccacatatgcgattgtcgcagcacagctcacccggagccatgcactggtttccacagacggattgcttgcgacagcaagtgtctctgaacagattatcagtaccattatgtatgtattcagggctggctgtttgcgactcacccttccatgcagacttcttgggccgagcagctgctgcgcccgcaacattggcggtcactacctatacagttatatttcccttctcccgaatcatctgcataagaacagagaatctgaccagaggagccacagcatctacaaacactcagcaatgctcgaattgaaaatgaaaaacgaggagggagtgcggctctcttacccccattggctgcctgccaacacagagctgggacagtatcgcccatagcagtcataggacttccagccatcggaactagaatcatagcaagtcgaaccccccttccctctgcattttaggccgccgtcaatactaccgcagtcgaccgcttgcaagtagcttatggactccatctcggtggtcgatgccctctagtgcctgctcgacccgccgactttggaatagcagcacgcgcagcggccactcgggcgagagtgaaatgtcgaaatgtcgaaaatggattgtgaggattttgggaagaccaggtcgcaggcctttgtctggggtacgtggtgggcagcgaccactacatattcgagagatgcaactctgggatggatgctagcaagggggtcgatcgagctaaagcagcgtgatgggttggggtcatgcaacagctctactgatggaggacacgagcgaatagggcctctagaaagcaatgaaaaggccataatgctatcatttcgaagtgccataatcatgcatgggctccgtttcagctcagccgctatgtgagcgcagccagccaggagggggaaacagccgaatatgaaacgccctacacaagcgtaccgagctctagccaatacctggcgcgctcgactcaagccgcgcctcagatcctgatttacgagcgcaacgggcgcctgggacctgtgctcaggattcttctctgcctctggatccccacacttgaactgttcgggtcctgtctggaaggattgagtggctcgctcgtcgggagcgatgtgacgaaggtaactcttttggttcgtcacagagcgagttccatgtgagacgcctctaatctcctgccgctttactccgtttgctttgctatcaccgtagctaaagcgtggtgcctttgacgtgtctacgccagatagctctgccgtgccaattcaagccctcatttcgtcgtctgggagaattatgctagcgtatgtgcaaaaatggtaattgattgttgtcttttaaattcgtgatgaatatcacccatcccacggtgtgggggcgctgaacacgaacaagctcgtaaaacatccctgttgatttaatttgtgcgacatgactgacgtctgacgtcttttacttgaaaccaatttatctccattggctggcatcgcattgtttcggtagaaacatcccagcccaggacgtcgaccaccatttatttgcgtcaggtagtggtatatggaagaggcgatccataaagagatataggagcaagaaataaaggttaggtcgctcgccaatctgtttttagtgccaatcatggaactgttacaagcatcggtcaaatattacggggcgtagttgaacaagatggtgataaacatacgccaagagaaattagagctcctcgcagcgatacgccgtgtgcgttttactcacaaaatctgcccccaagacagagggcacgccaatccttataattatcttagtgaggaatccttcgaaccacctttacgggtcttccatggctgacccctgttgcgctggcccatcactaaggcaagccggtactggcaaggggtccaaagcgcagaacttcagcaaggctcgctcacaagccgcatcaagagcaccgtgctctccaatccaggtaccctggctatccttggttgacagctttgtacccaccagctctgtcacgcttgtagtctcatatccgcagaagatgggagacggaggcaaacctttgaggaaagtcgatatagattttcacagttccaatctcaggcgaacagagatttttattccacctgatcataaacaaatccacatggatcctggctgcaatttgtttccggccagtaaggaaggtcaggcgtcgcgaacagctgagaagtaatctgcacgactaatcttccccacggcacaagacatcaatgataggatagcctcatgatccgacagcaggttacttaccaccatcaccatgaaatccgaaccagtgaagttggccaaactcaccattcgggaaagacatctaatggatatcatccagtctgttatatttttaaagtcaagcgtgtcatcttaagcagacattgacaaacgaaagcgaaagatttagagctatttagtgatactcaaatacccgaacttcttggtatatgccatcgatgtaataattctaaattgcgagcaagagcaaggaacagtgtttccatacaccatcaatttcgcaatgaccttcatttacagtcttacgggttagatgattactacgtgtacttttcttcttacagcgaactaccctttctatactccagtcacgagatagaatgataaaccctcccaaaattatcacagatacgtacgccacagatgagagtttcgatactataaataaagtctagctagtttgaaaagcacgagtagaaaattctaagtaaaatgaccattcgtctttgacaaataccagacaacttctcgactagtacgattcatataacaaagttgacgcgaggtaatttggcacaacgtcaaatcggacgaatgactgttgtaggttgacaaaataaaacactaaaattcttaagaagccatgcgataatattcaaggagaatctttaatcaaagctaggccgtgccaagcgcttctctgaaacggcttgaattctaaataattcttcttagtcgcttgtttcatgattcctatctcgttgctcacgtacattctgatttgttgcattgtatgcatattctgcgttctcatcggtctgcgtcgcggcatccgacatggtccgcggccgagtttctccatgatcccatcctgtgcgaggcggcgtccctcgtgttggagaaggagactccatactctttcgatgatatgtgttgaagatagggctcgtggggctgggattgaattcaaactgctggctcgccggtctggagccggtgccagcttccaatatatcgagcccttctttctcaagtgcaatgacaccatacggatccgcgtcatccggctccgggatgccaaagatcttgccgttctccgaggcctcaataggcacatcgctcgggacgggctcctggtctagtcctccgaggatctcgccgtccacatctgttcggccttctgcagctttcaaagtctccatcaatcgcttgatgctggctggtggatgacggaccttgccggccaagatgtccgaaaccccaatggcttctccataaaagcgtttgttctcgtcgctgcgctcaatgacaacagtgccgtcgacctgaacaccggcgtagaagcctcgagatttgagataggtaaacacaggtctgttcgcttccttccacttgccgtcattctccagaacaccacccattccgaccgggccagcgacagcgctgatctcgcccccaagggtcgcacggatcttggtgaaagcttgcagagcctttgggttgttgatgacgagcacgcagtcgtagatatccacgcctaaaaggaagcccagtccggccgtatgcagcatgatacctgatggcgctgaccaagacccgtcttcggtcctggcaaccaagacgccggagccgccggcaccagagatccagagtccagtgcgcatcgtggtgaagatggcgaggccgacggcattctcgatgaccctttgggggatcttcttcaggactttctgtgccttctttgggcccgcttcctcggatgacggtgctggttcctcggtataaaatccatcctctaaagtgtggcttgcgtcagcggttcttcagttatcaaatacctcaggggtattctagggcgcattcaagcttccgcaaaggagattgaactcactgcaaaatgacctcaagattctagcagccttgtcgctttctttgtcgagagtcgtgggccagaacgcttcgctgccaacacggttcgatagcctattcacaggggccccgagcttatctgcccaagaccacactttatcgaatcccttcttgctttgggtcttggtcgtgtcccaggatgggagggccgccgttactttcttcatgctgtgcttatgccgaggtgcgatggttttaagaatataagaggaaaaactgcagaaaactctacaaactacgagaagccaaggccaaccggtagataatcaaccaaaatcgcagcatcgccaccgctcaattcgtgtctccgtctttcccgagaggcttccgggacgtccggtggttgaagcttgacgtcacaccggagccttagaacaatcaccagacctctagaagacatgtgctgtgttaccaccagctgaggaccttcggggtggaatgataattgaaactagcggatcgatggcggccaccgagacgtgctcctgtcaatccaactccgagtgagcctctttgcatgggtaaaagtgtatttgtggcatatcccgaggtagctccaccaccagattaatgttccgagcaacactaacgcatccgttgatgagattagcgatcatggcagttttgttctttgttggtgatgacctgggcgtttttatttgctgacccgtgtgcctcggcaattccactggccatcaatggtagcatccaagccggatgtgccttgtgaaccatgcccgtgcataaggaccgaggaatggggtgagcttccccgcacagccataatcagtgagacacgggccaggatagccagtatttaactgaactttgtccattcgtagctcccgtcaagaagacaaaaaggcaccctggcctcttgagatacgattcaaggagcatagtgaagagcccgccgtccagccaactcacaagatgtcagccaacgtcccgttcgccgagccgccttggctcaatggcatcccatccccgtacttcgacgagtcccacaagagggtccaggccgcgtgccgcgacttcatcggccgcaccctgagccagcacgcgttcgagtgggagacggccgaggacgtgcctccccacgtcttcggcgagttcgcaaaagccaacttcctcgtcccggcactgcctgctcctctaccagccgaatggctgcgtcgcgtgggtatcacccacatgcctggtggcatccccgtggaggactggaactacctccacgcgctcatctacgcggatgaggtacgtcatatccatgaaatattgaacctttgctctccaaaaaagcctccgctgacatgaaacgcgtccgcagatgagccagtccggcctcgctggccccgcgggctccctcaccacaggcatggcgtttggcgtgccccccatcttccgttacggcagcaaggagctccaggagcgcttcctccctgacctcctcacgggccgcaagcgctcctgcatcgccatcaccgagcccgaggccggctccgacgtggccaacatcgtcaccaccgccgaggtgagccccgacggcaagcactacgtcgtcaacggctccaagaagtggatcaccaacggcgtcttcgccgactacgcgaccatggccgtgcgcacggggggtcccggctcgggacccaggggcatctcgctgctcgtcgtgccgctcaagggccacccgggcgtgtcgctgcgcaggatcaaggtctcgggccagatcagcgcggggacgtcgttcatcgagctcgacgacgtcaaggtgccgagggagaacctgatcgggcaggaggggctggggatgcactacatcatgaacaacttcaaccacgagcggctgttcatcgccgtgggcgtcaccaggcagtcgagggtggcgctcagtgccgcgttcgagtactgcctcaagcgcgaggcgtttggcaaggtatgttgataatgataatcttggcgggatgatttcccaaggcccggctgaactaacatgtcccttcagaaactgatggaccagcccgtggtccgccaccggctggccaagtgcctcgccaggctcgagtcgcagcaggcgtgggtcgagtcctttgcgtaccagctcaccaagatgcccaaggagcagggcgacaaggagctcggcgggctcacggcgctgtgcaaggccaacgcgggcaaggtcctcgacgagtgcgcccggtgcgccgtcctgctctttggcgggaacgggtacacgcgctccgggcagggcgagattgcagagagtaagcctcacatccctttcttcttcttcttcttcttcttcttcttcgcaaacttatcctttggcgattgctaatgattcttgaccgcggatagagatttaccgagaggtcccaggtgcccggatcccgggtggtagcgaggacgtgttgttcgatctagccattcgccagaccgtcaagctatacaaggagaaggcggcccagctcaaagcgcagtcacgtctctgaagggttagaattgatgtgtatagatattcgcatggtagtttgaattcagttccatttattgaaatactatgtacttccagttgaagtcaactggatgcgtaaaatataagtactagaaataggtggtatcgatgatgtatgcagctggctcatatccccgtcgttacccaaatgcacccaatgcaatgctcccgccccaaaaacaaaccaagaataggcagtcaaattggtataaattaatgaaaagaaaaacgagccaaccccttggcaatgccgatgctgtgtaaatgctgatatgcttcatgagaatgacaaaagaaaatatgcagatgtcgcgctcaagctcctctcaccctgcccagcgtttccagaaccagccggaggataggacgggaggagacatgctcgacaccgggggattagaagattcgtctattatgcgcggtccgtgatttgcgtgatacatgttatgcgtgggtttagaagaaattatacggccggcggttctcgtgggaggtgcttgtccgcgtccgcgtgctctgggcgatcgacgggcgacggacgtaccttgagacttctctcaggtacttggtggtgccgagggcctccatgcgcttgccgtggtgttggtgggcgaccatgcgatcgcatttggtgcagaagtgcgtgatgttgtacttcttgtccttcttggcgctggagctcatgccgaatgtcgcgatgaaaagcccggtggtggcaatgctggtgcgcagttagcaaatcaatcaatcatgtctttgaggaggggctccttactgtgtcaccttggagggctcctttttcacacgtgtctcaacgcgacgttggcaaaatggacagtcaacccagtccggctcgtcagagaggaggttcagaggcgtcaccgactcgtcgtcatcgtcgtctgactcggtatcaagagaaaagcgactcaagggcgggatcacgagactgttgcttcggaaaagctccagcgatacagtcgactggttgagggaggagatgaccacctccgggaagccgccatcatcaacgggggacatgaccttcttccttgggtccctcgagtcccgtctcctgtaccccgtcgttctggcagtgctggtattacttgcgcgcttgatgctttgcctgatggcggattgtctgatattcgtttctaaagcaactgtctcgatggacggttgcgggcgccgacttgcacacagcgacggcgatgtcgagtacatcggcttctcctccttgctcccagtgggaggcgacatgagcgggtcgatggcgcatcccttgatatcatcgggggagttgaagagcggcgaggcggcatcggggtcgactggtggtggggagacgcagtgttccgtgggttctaaatgcttgatctcaccggcaacgatgtgagtgtacgaggccatgcgcctcaggctggcgaacgaggctttgcgcgggagatggatatcgaagctccggtacctctggtggcgtgttcccagcatgatggttgtatgagtggtggtgtaagtcagatcgtgtgcttggcagtcgtgctctcaaaacaccggccgccttacacttgacttcggttgtctgttagacgctgggtggtgttcaacatggaaattccaaatgaggcttcaattctctttcccgggcagatccagaagggacttgggggcggttatatcgatccaagacggcgagagatacccccgcctgcaagggagtgtgatcccgtcgacacgcgcgacttggtccccggccctcccatcgcccatggcagacatttcacgcacagggcagctgcccgactgctacaagggatgtcccatgttgcagtggcgcttcagaccgccagattgcattgggaacgcgctggcaaagaggcaactccagcaagagtcgaatccaggccttgggcagcctccaagttccactgaaccacggcggtcctgaggtgctgacggtcctcgcagaccactgtaattctacaccacagcgctgtttcatcaacgccatcaaccatcaagattggattaatttatcaccgcgggcggttatttttggtcttcgccattgggtttgcagattaatcctcattcttgactctacctactcctaacgagcgggtagcagagaagtgtcaccttgagaatacacacctccatgcactcgctgcttgtacgcgaaaccgtgctcacacaggtctgtttcatgactggttgcagaaacgaggccatcaccgaatttgccatttcctgccttcgaatgagacttcacgcctttgcccagcgggaaaccgtaaaatatgccgaaaagggagaatgctggggcaggttttcgcctcatctgtttcacgccagccttggatctcagctgtcgagcaggcagggatcgcttcattgctcatcagtgtgcgctaagaataaccaaagtccctttcccatgttgattttcaccttccccttcccacggcctcagccctaattacatcacgagccttgtccagaacacacgaagcgcgtatacgcttattcaactgcacaactgcacaattacgtcgagtctccggggcaggtgtggcgttactgctaaaacatctagctaccatgcaggaagaagaacccagccgtcccttgcataacatcccggttgcgtgttgaagctgtccaaccagaaccgctggccaacatctccgctccgctcgcactcggcaccgggcctttccccaagctacatcatcgcaacgccgtggatttgtttgttatgccagaggtgcctttgctgcacgcatttgcatgctacagtatcagcctaccaacaacgcggtaattgattgccaggcgtgtttcattttatcgttgtttccaaggccacctttgccacatgagcggtcgcacattgacgtgtagtgtaagtcagccattttgatgtcatgccatcattttgttgattcagttcatttcttttcaaatgaatcgtttttaattattcctgcttgctgatccacctcacgtgcatagatgactggcatgatggtctcggcaattctctacagccacagttcatggcccccaatcctcggcaacgtagaatgcagcgcctcatctcattgcagcatcgcagccggccgaggcgtgagaagttaaacgtatacataatcatgctccatgcgcaaatcgattaatgacggtcgaacaagagagattgccagaagaaaaccagaagggtaaaaataattattttacttggattaccatcatgcagatcagagttgaagtatccgtaaatagctggatcaacagcagtatccctacgagacagatggacaaggttcgcactatattccgctttgtaattttttctcactctaatcaatgtcatcttgaaaattcaagaagtatggtgtcccttcaacattcaagatttgatgattccccgctagtctatcaacctttcgctaattttagacttggggaagcgactatggatcgcatctcatttcgctcgggagaccaatttccttcgaccctcttgggtggaaagatggccatactgtagtgtgtaggatcgtgtgtcgcgacagggttgtgtttcacatctcgactagaaataagtcatttccgtggcttctttggcacaacaggaaggcatgaagatgttccgtgcttttccatccattctggatgcttcggcccattccgcatcctgctcacattgtggaatggcataaacctaaaaaaaaaatccgcaatcttatgcttgtgaagggatattgtagcacgcggtcagcatgacatcaatacgcgactgtgggactccgcctaccctaaacaccctaacccaaaccttgactccacgatacatgcaatgagctgtcataagatagcttaattataatctctctaggaagtaaacatattctatcctctgtgactatatttaagatagcgtctgttttgttttcacctcttagttgtaaatgtctgaggattccaatttctcgcacattcataacgttcaccacaagctattgtatgtctttctcgcttcaaattctacccaccgctctggaaaatctatgatttctatttaatttctagctgactaaatttgtcgactcaaaccgattgactccgcggaagctttaattccgggcttaatagatgattgttgacccggccaaatgttccttaattaggttgcacagatattgagcgtcttgaatataatggtatctactaggcgccactcgctggagccgtgatcaacgcctttcgctgacttagagggattggtgaatttccacacaatgacaaaaataaacaaacgtgatgaaacgcccaaggcctggtccctattaaattaccgtaggcggtgaatggcgaagcttttggcaagtcgaggtaaattcgacgaaatctcacgcgctaaacccatttcatttcgtttattctcgccttgttctaggtagaactaacccccagctcagaatattaatcacgcgagtctagggagcatgtgtttgtttatttcatcaccataagcatgactgtttcacacagttctttttttgtaaacacatgttacggtctatacctaatcttttttcaacgtgaaaactcaaacaatcatacatatagcctaggcgtaggcgtaaaaataaaaaaaatttctgtcaagggctggtcaacgcctccaagggggatattagtactcatcaccaccaaccacagccacctctctcaatccaatccaagccaaacgacgatgtcagcatctaatatcatcacccttacttgagatatgacaaatataagtagataaaaatctttaataaggctttaaaagattactttcttaacaatgatgaggcgatgatgttttaaatgagatcggaggtaggcgagggagatttcctgcaacattttgccagtttcattgagcattgcagcgtttgtaccaaaacggacttcacagattaatatggtcttccattatacctcaatgcagcaatggcgactttttgaattttcttgaattctgactttgaccatgacccatcgtcggtgtgaaagttatctgattacattttgccgcctccctgcacttgcatatcgtaacaaggagcatcacaataccttcataatctggaggggcgactatcttcactgctagatgttatcaatctatgactcgatcccacagataatagtctaagacttacttacttgatttgttcgagagcagctatgcagtcgatttcaaccttgatagatgttagtatcctatcctcttcaatctatggccgagaggttcatcgctatcaaaacttaccttggcaccgcgccctagcacaacgttgctgacacaaactcgagccggtttggggtcggggacaatggcaatgtctggcatggtaagataatgctcagccgcttcaaggttcgaattcttacatgcggcattcatagcggcgaagtcggaaacatcagcgagaaaaatattgcactttttctgttaggcctggctttggtgatgtaaagtggtgaatattaccttgaggatacttgaaaggctactgccggcggtatgaagaacagattcaagcaacttgagagccgctttctgtcatattatgaagaatgttaggatactcttcgtaatgtcagggaggggttggtgcgctgtgccaacacgcttactgtctgttcagccacatcatctcctactagctgtccagttactgggtcgagcccaatcttcccactgcaatagattacatcgtgatgtatagtggcttctgagtacagaggcgacgagaagtttgttctgttgaccggttgtttcgtagtcatttgctgtgattttgtcatgattgctgtcacgttgaccagttttttatccttggtgcatggagaagccggggagtgtcaatacgtgtctttatcaactccgtgccttctatggggtagagcgtcccggtatcaacggctctgccatgacctaggatattgctggaccctggagagctccggatggactagatagctattgattgagtctagggttctcgacccaaatggtggagtcatgaggttcatggccgagatacttagtgcggggagctgaaggctggcgggggaactgctgataaagttagatagcattaagagttgagccaatcggaggagtccttcgtattctcccgagtcaaacggccgtcacctaggaagatttgtaactctgactcgtgatcaagatttgcagtttacactttcagaatggttttggggttgatcgcgaccatataatagacaggaccatgcactggtctcgattgagaggtcgtgaatttcaaaataggactttcactaaaacgcactcattgagactttaaacgaacagtgcatctgaagatcatcacaagccgcaaacgacctcaacttcaagatggccctcaagaagctctttgaaccatttgccaagcatcacagggcacttaaagctgcacctcaggagatctataatcgacggttgattttgtcatcgttgctctatgctatggcagctctcccattgggtaagacattgaaattgttcgaaacacttgtccaagttgaccaacaaatgtaaagcttgggaccaggcgacaactgcagcgattccatccctcccaggcttccaaaaacatttccagctcagttccgggagcagcgcccttgagattcgaaacttcgtctccatcgtcttcgctggcgcgggtatcggcgctgggttgtcatttttcctcaacgatagactgggccgccgatggagcttccgtgtctatgcctgcatctggatccttgggcaactggtcgctaccgcatctccaaccttggcaggcctgtatgctgcacgcattatatctggtttgggcatgggtgcactcaccgttactggccccatgtccatcgtggagatcgccccagctgagatccgaggcaccctcacagcctggttcaatgttgccatgaacatgaccgcaacagctggcgcgttctgtgtctacgggatccagaagaacatgtcgactagcgctcttcagtaccaagttgcttggttctcgccctgtgtcttcctcttcatctgcatagttgctagcttcttcgtcgtggagtctcctcgctggcttttcctggtcgatcgacacgaggacgcgaccaaggcgctcatcatccttcgaggtctgcctgccgagcattctcgggtgcaacaggagctcatggacatacaaaacgccattcatgaagaaaaggctatgcatgacgagggtatccttggcatcttcaaggaaacctttctcaaagcttccaatcttcgtcgcgtgcagcagagcctcgtgacgtacgctcttgcgcaactctctggcgccaactcagtcacgtcctactttgtccctatactcactctcattggaattggcggagacgcgtcgaggaatatctttctcagcggcatgtacacattctctaaattttgcttcgccatcattgcgtccttcttctttgttgatgcactaggtcgacgcaagtctctatttgtgggagctttcctccagatggtttccgacttttatattggtgtttacctcaagtataggcagcaaggagatgtttctaggtcagcatccactggagctattgctttcatctttattcatggatttggctatgttgtgggtaagtattttgagactgatttacaaatatccttgtgctgaacccatttataggcctttacatcctaccgtacgtttttggtggagagttgtggccaaacaggatcagatcatttggttcggctctttcccaatgctttcactggctgttcctcttcgctatggtgtacggcgcgccatcccttctagaacagactaataactggggtgcattcatcttctttggttcttggtgcttcatatccttggtctatgtctatttgatggtgccagagtcgtctggcctaagcgttgaggaactcgatcgtatctttagtggctcctggtttaatgccgcccgatcgacgggggacaacgttactgtccttgagggccaggaacacggaaagaatgtcagcacgtgagtcgaatcgtcttccactatgagatgcgcatttagtgactgtttctagtgatgagaaagctgcaaagtctgatgtctagtatacaaacacgacatggaggaaagggggacaaattgggtagagcttttgtaaaggatcaacggtattgttcataaaagagtcagtttggatattgaacagggatgtacggctaaggtagtttaatatctattattcttattgagcgtcgagtgtggacctctccgttaccactcttgctttgtaaactgaacaccctcgttggcgtgccatagagaaagaaatcaattattaatttttactcaagaataaatgttgtcctagaaaagcactgttatcaacagcctgaaaactgaacataacgtcagcgggcaagaattaatcaatgcattgccattacaactgatacattgtgctgacatcagtcccatcccacgattcatcaccaccttcacaagttccgctgaatgagaagtcatcccccaatccgctcaataacaaatccacccctagagaaataccagaatccgcgattccagccatccactctggtagatctgccgaataacgatcctgttctgtggcaaaccaagtaggagcggcttctttcccttgttgcttatcggctatcattgtcatcgtgcgactggcaagagcctcaaagacgtcgcggtacggggcggcgtccttccatcgttcggccattatgacaagaaccatggtgcaatctgtgcaagtactgctgatctgatcatgacgaagcgagtcacgagcactggatgctttccataagcagtacagatatgtcaacccagcaaggaacagctcgtgcaaggcaccccaagtaggcgttgtaggcgttcccaaaaattgacggcggtagctgtggcaggcgctcttggctgcacgcatacatttggtgatgatgtcgggcgggactgaacgctgactgtctgttatatgaaatcggtagagctgcagaatagcagagtcgtagacggcttggtaccagtcgggagttgtgaagaatgagagagcaccaccatcaggaggcgaccttggaaggggcctcgaagccataagcttgtctaattcctcgagtaagtcctttatatgggcgttctggcgatcaaagtctgtggcagtgttatcggaatacagcgttgagtgaatacggccaagcaagtttcgaaaacggaaaccatggatcgcatgtgtcatcattgtgggtggttcggatggggtccttggtgattcgcatagtccggtctcggtaaaacaggaatcctcaagatcgagaggaagctgacatccagaaaaagtcagagcctcactaaatagataggctacatgatgattcaacttacatctacatcaatttcctgtaggcggaggctcaatggacgccccaacagtagcgaggctgagcattccattgagtatgcgctccaaaatgctcgtttttgcaattccgattgaagctgacttctggcaagccgcagtcgcttatgatcacggtggtagccaagattgatacattgccggagcgcctgaccggcaagcttcctacttttaatcagtgccaggtttatacatctaattaagatgcttcctaccaatgagaagtccctttggaggagcgaagagaataagtggccgaacaaagaattgcctgtatacattccaaattgtcgtgatacagtatttcgtcaatgtagagtagggccgaagcatatagccgctctggggaatacccaggtgttggcaatagcagagctccaacggcgtacaccttgaagtattgttggcgattcattctctttatttatatagaaagattgtacataccataaagaggaagtaaatgggcacggatttgtactcgaggacctcgaaagggccaagtggactctttagtgccgattcccatatcctgaacgttggttcatgtagaaatgggtattgaggatgtatattctgaaaatatgcattgcttagtctgacggctgtctggtattctggcagagggcacgggttaagcatcgagggttggttagaaccctcgctcgctttatcaggaggaatagacgacacgacctgtcgcagagacggctcgacgaatcgtgcaaaggcaaagacggaagatgagcctagataatgtggctctgcccctgcagcactcaagcttagggtgccaatcatggaagatagatcacttaactcgtgttgctcgctactactcctagggtaaaaagttgatggctcgttgctcggtgaagcagtcgatccctccaagtcagactcacgaagcttgccctccaagaagcggacacggtcttccagtgtctctagatagttgcgcggctgttgtcgttttgttgcagggtcttcgacgaggcatactaaaattcttcctcggttattaaggccttctccagggaagagagcgtccgtttcccacctgaaccaattctgcgacaattggagcatgctgggacttgatcgtcacactgtatcgatatgtcagcttcgctgttgttcccactgaccagaatgttcataccctcaatttccgctccttgcagcctatgcaagctaccagcattctgtttcctgtccggacacggtgcgcggctccttttgcaggccgactccttggtagctcaggcatacttgtaatgagcgcgaagagaatcagacgtgaagatccagtactttgaatcgtgatacttggagtggtactgtgatttagaccccgatgatgacaagacgaagataagagattcgtcgactgcgctaagtccctgcattacatcacgccagtgagggggtccgaagtcgcagacaaaacaccaataagacaatatcgcatcgaatatttcgtatcgataacaatgaggacttttactctcatcaagcttttgttccctctgggcgagatttacatttgggtcggaggcccgggtaaaaatatgtatagagaggacgtatgtagatggtggagatattgatgataggatattttctacctgactttactatctaaggctgcaccaaaaatggtcaataataaacctactagattgtagcatgaagattctagcatcatattctgatgaacataaaagataatcccagctatgagcccaattggtgatttcagaggatatatggcactagagttggcctttgtatgcgtcgtatatgttgcacgctgaaccatggcggcattttttttagagggataaaaaacatgagacatgaatgatgatcggcttattgccactgtgaggaatctgaggcccttgatcaaggcattgatcgaagcattaagttcaagaacaagcgcgacgttttgatcagttggatccgatcccggtccgctcggttcggaagaatacgaagagccaataagatgcgtccaatgtccgtgtgccataaccgacgcggaaccgttgactctgcattcagggatcctcgttgctgaactgtaatatcatgtcggaggaatacgagatgattaccgtcaaagacccgacttgccggactctcgggtcgagcaacctcatgctggaaatgctaataaactagcaatatgtgccttcgaggtctcggagtaagccagaacgagcgaacaacacgcctgtcttgttttatcaaagtataccacatataaaaacaatccatgtcaaccacaagcagcaatggaaatgacgtcccatctcactagtaaagcttctcccatcgtcattgtcggcgcaggcgtctttgggattagcaccgcattgcatcttgcagagaatggctacagcaacgtaaaaatactggataagcaggcgtatgatgacagccaatacagttacgacaaaggctgtgatgctgcctcagcaggtacgtggagatctcatcttcctcaagaattagcgtctcactttcatggctagatatcaataagatcattagggctgcatatggttcacaaactcatcatcaagagcttgctctagatgcaatcacgcactggaagagatggaatacagaaattcaaacgggccaaaacctgcctccaggttttacgactagtgataagttgtttgtgaataacggaaacctgagtatgaccttgagccctgaactatcacaattcgagaaggataccattcaaaacatggccaaagtaggaagggcgaatacgcaaatcgtgcttactgaccctaccgatgtggaccgtgcaaaggcgagcggcttcgactttgccatcaatccttttaaccgacaagataattttggcatcctcgatatacaagctggtttcgtgtacgcagataaggcctgtcgttttgtccttcataaagctcagagtttgggagtccaaacagttctgggaggcgccaaaggcacattcgcaggttttgttcaggacacaacttcgaaaattactggagtccgaaccgcagatggtatagtccacggtgctgaaatgacaattatggcctgtggtggatggacgcccacgttggtccctcagctcgacaacctctgcgagacaacggccgggagtgtatgcgtttttcaactgccaaaaggttcccctctgtgggatcgcctggctcctgagaacttccctacatggacgtgagtatgctcttctaccacggaacagcacaagagaaagtgattcctgactaaaccacttagttacaatattttcgccggtgagaaaggaggtctctacggattcgctcgagacccaaatggggcagtcaagattggttaccgcgggactaagtttaccaatccgcagacgcaagccgatggtgctgctaggagtatccctaccacgcgttggacgccgcagccgacccggaaaatcccagcaacggcggctaatgtaatcaaagactttgttcaaaagttcctgccggagctcatcccgtatgagaccaagactcggctatgttggtacactgattcatttgacaaccactttgttatcgattttgtacctggctacaaggggctgatggtggcaacgggcggaagcggtcatggctttaagttcctgccgaccctgggcaaacatgttgtggacctcttggagggcagatcaaatgattatcttcattactggaagtggaggagccccgaggctagccagaagccgtacaacagcatcatggaaggcatcgctagtgaaagatcccttcatgtccagttacttactgctgaagacagtcttacagttcggcagagtcacttgtaagactgacatttgatggtatcttgatgacatctgatagatagagttgcactgccggcgctgggaatctggcaatgcggcactacttattctagatcggtcgcgtacaacagatcgatacacatgcccctcacaaaggatagaagattgagaaagtcgctttcgttcattgaatctattcaaaacacttattctaaacggaaatataaataagagaatatgctgtctctctagacatgtccattcgtttgcacagcggcaggaacagcaacggagagcaaaggtgcatgctgagcagtgcctagagtatcacgctcgccgacgctcccttgagcccagggtctccgaatagtacacttccaagccagagcaggctggaagtacatgttcaccacgatatcctcatccttgatttggtataaagacttgattgtctcgttggtcaacacattggcctccttaacacggttaaagtgcatctcgtcgtcaaacataatatcaaatgtcagctcaaaggggccgctgttcttagatctcacgacgctggcgatgtcgcgtatggtgatggctgaggtgggtacttgcttctttggaatttcttggggtgatacgccgaggaaacttttgagctcataaaactgctgtccatgagacggattcttggtgtatgtcccaggaccgacatcgagatagttgatggggaacagggttgggtcagccgcgtcatcaatgtccatgagatggtagacgctaaacttgaaaacggcacctgcatcctgctcgtgagggctgagagggctggcgaagtttccggttgtggcgaggatgcctggatagtagagatgcaagcacgaaacacgggcactgtttgcgatagccatggcctttgccgcagtgggcgctacaacctcgccgagaacaccgacttcgtggctggggactggattaggttctaggggtcccatgatggcgttacgaccatagacatggaagatgagtcggcagtcgtcagacttatcgagctcgggaaatagacctcgggtgtaatttcggacgcggttctcgaggaagtcatccagtcctgctatgaggatggggtcacggaatccaccaataaagatagcgcggtgcccgactggagagacaccctccagtttgatttgataggttggagtcgggacaaagcgagaaccccagcatcgaacggtacgtccatcttctaaaaccttgtagctggcggtgtcgaggtgaagcacaccccctggcccaggaagctgatctggtcgggtcttctcatacagtgaatgggctgcgacggagaggggtgtgcatctttcaatggggtttagaggagtgagatcgaaggaatccttgcggatggtagcaatcattgatcgacccttgggcacagcgcactgtccgccacattcgaggatcttccctaggtggaaagccggagctgtctctaccccaaggttgatgcaaaatgctgcaaatggtgaaggatcgtaggcacgacccgaaacgacgatgtccgggttgccttctttgagagccctgacgaagctgaaagtatgttaatacacagtttctgttgatatattgaggaatgctaggggaacctacggttctggtcccatctgagcaacaatatcgacagcggtattaacatcctgttctgtcaaggccgggacaggtccgcagggactgattttgccttccttcatcttggacaggacaatttccttgctgacggaagcaccaatagtggcaaccttgaacttgaagccgttgtcttcaataattttgttgatgatggcaacgatctcggcaagatgtttgtcgctaccatctccaccagcactacttacaagaagtttgattccgtaatgagcacaggtagtgacatatggagtcagatctcgaatgtaggattcatctgctacagtcttgcgacccatccctagtttgaagggaccaccgtctgtactgccggagtcgatgacgatggcatcggggtgatattcgtggatgccataccagaaatggtccgccttgtaaccataccttatgttcagattataatgtaagcttgattaagcgggagagggtgtctttttactcacccaagcatggcattagccgtgaggatacggatctccccgggctcttttgcgtatcttggctgggcggccatctcggagcgtgtctgcggcgagctcgcttgatgggttgtaatagactcggaataagcaacgctgtttaagctgccgaattaagagagaatagaaattgatacaagtatcctatttgaaaatgcaaaaactcaaatatccgttccttggctcctgttgttcagattcaactctcgacgctgcatccccacaatcgtatatcaattcggtgcctgcccgcaagtcagctcggcattctcccgcaaaatcaccctcggtcttagcccgcacttccatccgcatatggaatctaggtttagatgccgcattaggaatgatgttggttgaacttttacggctagcctgagaagcgagaaaatgtggacaacttccccctcatctcgtctcatgactggagtctccacctcgttcattaactgctggggtcataaatcggccttctttcgttcatgctgtttgttgcgagcggacacaggcaccatcacgatgtcggaccagacgtctccgcaatccctccagacattgcctgtggcctgtgaacaatgtagaagaagcaagagaaaggttcgaaactgttggctctgatacaacgtatatccgtagactaaagaacgacaacagtgcgatcgtgtagcacctcgatgcggatcttgttccaaatccagtcggaaatgtactatgcctgatgttttggaacagcctgctgatagaaccaaacgtcaacgaatgccgaaagggtgaagttattctgtggccataagtatctagcactaagcgctaatttgggtttcagattcgttgaaattcttgaagcaagggttcaacagttggaggattcgatacagaaccacctttctgaactcgaaacactgaaacaaacaagtcggtcatcctccaaaaatgaacctcttcttaccgaatccgcaccgcccaatgatgagctcgaagtttctacatctgttgtgacggttcaaagtgaaaggcccgactctccactaggcttgccctcattaacgcccggacaacatgatgtcgtgactgctcctgagcattcgtcttcatcttctccggagaaggaagtcgtataccctctcagtgcggaggctatcgtttcgcttagcaagatgagcgagagcaacgagtatggattgttcaactctacatccgttgcctatgctatgttaggcgctgacggcggaagtccgtttggctcatctgtcctgagatctaacatattccaagacgattcgcacatctcacaagagcttgagttatcaaagatgttggaaagcttcttgttaaaccaaggcgagaccctccttactcgttacgaaaggaactgtcacagccggtaccccttcatacaaatggacaagttaaacgaaataatggaatcctgcaaagcacaggggagtctacagccaattcaaagagcgaccgctgcccaacggtttcacttcttcactgtgatggcaattggtcttgctatggaagggcgaagaatatcatttgcagggcagattgaaggaaacttgttcatggtggccgtaaatcaccttggcggtgtatttagattctctgatcccatcgaccaaataagcggtttgttacttcttactatctatagcatgtacagatcatcgacaggaagcacctggcattttgctggattcgccatgcgcatctgcattgcgcattcataccataccggcgaacattcggaaaagattcataaaacgttctggtctacgtttatgcttgagcaaaccatatgcgatgctctcgagagactccccagtttaggtcccgtggaccttttatctcaggtaggcattctattagggagagatcagtcatgatggctgctaactttaatcagccctgctcgtcccatggaactggaaatccaagttctttaggtgacgatgcttggtcttattgggtgacgcgcagccaattacttgcaaagttgagcaacaacactggggcttattcttcgtctacgcaatcccttttctccgtataccaactcaaagcacgccatccggctctaccgccagaggatgcttcattggcaacctcagtctttacgaaagacgtagatcaacagtacctttacgatcttgtttccttttctgcccgaattgacagcgccccatctaaaaagcttgatcagttctgcttatttgtatctgccttgataatctgcagactcacttccctcgaggacactcttccatcatggcccagaggcattcttctattcagagccggcatgatatgtctacgaagcatgggcgtccttgtcacaactgaggatagcaacaggctcagctttatcctctccgatacgttacgcaaatgttctgactatctctcacgtctttgtagcgaattccaagaactagcccgatacagagttgtctttgatactgccgtcagtctacatggctccacgaacagtaaagcaactcaatggactaccaatcccgaggtccctccaagtgtagcgtctctgtcaacgacacttgatcaaaagctctccaggaaggcatttgaagcgattcaggcgcggggcctgcaaaatgatgcgtttagctcggatatacatgccgggctaactcggctggtttcttgtatctgctatgaatccgacgaggagcgtcagatatacgatgggatattttcctcgcggcaattagcgaacctcacccctcaataaaaggaggaactttccgttgcccataactgtccattaccaaacagtgcttcccaaatctctgtagcttcaccccactcagaaccaaacatggcagcaggatcgtacgtctctggaactccatctatccctacttccgaggttaagaaatccggccacgacgtggcccccgaagggtcttccaagtggttaccaataacagcacagcagcaaggttgcctatgctctacaggcaagtggcatgtgagcggtgccgtgatcaaactggagccaaagtagtctggagatacatcctgcattggtgcaaacgcggtggatatagctgcagtagaggtggcactggggtgcgtttgacgaacactatgttggaaagcttgttggccagaagaatctgacgttgtcgactcttgtaccgtcgactttggaagtatccgtaaagtttccctgcaaagaagctcaaagtatcccacatatctgggcgtgagatgttggttcgtcatttgtttggccatgcgatcaagtgtgtctgtgcatttcctcagtagtaactttttccccgatatagtctgccgtgatggaggcggtctagaagggccattgtgttgcttgttcttggtctgtcccatctgagactcgatcacaatggtatacaatatcgacagaccggccgttagaactcgatacagtctcccagccgtgggctcaattttcgcatcatctgcaatatctgagtacaatatgatcacattacttgcggcatcatataactcttcgagtagatctcctggattgatgaagtgggaatcggtcgcggagttaggctcaatagaaaggcggatgaggaaaagcttttcctggtgaaagtgaagatcgatccatctactatcatgcaggaagagctgtccgtttgaatcgggcgcaatatccttgtgtgtatgcattccgctgtataatctccaattgtgcaactcttgtgagtattggtagtaaatgctccaaaccttgccgttcaaagtgaataagtccaggccatcagctgagtttcgtgacgaccccggcgagtcttgtgaggtgagcaattgacttcttaaaattctataatctcgtgacatgcgagatgttatctggcgaagctgtatatgagagatggccaccgatgtgtcagtcaggcctttgggaagcgcttgtgcctcggttagctcgtctagggatgtgtttggcagtagactggccgcttcctgtaacacactatcgtctatattggcaggaagcttgacagtgatggcctcatctggaatagtgaatggccggccgagagttgtgctggcataccgctcgagcccatagcattgccagaagacgcgtcggcgcatctgttcctccatagctggaagaggggctgttggttgacgatgaaagccacattctatacacgtacgcatattgagcgaagcaagatcccataggctcatccctacgtcttggaaaaagcaaaagcgagcgacgaggagaagattctggatcccctgaatcccgtacagcatgttgacctgtttggcgctgcgcatggcgacagagaataagtccactgggctagccatgatgtggatgtcttccgtacttccatgaacaaacgactcttgatttagatacacagcaccagtcgccatgatagagtaggcccggaataactcttccgtggtgaggtgaatgagcccggcggagcgagcggctgtaagtgtcttctctcggagtgatatgattgtcgccagttccatgaacggataacgaggatgggctcttctgatatatgtctcgaataaacattgaataatatccggaggtacgagaggtgtagacgacgtgctgttgctaggggaggattggtcggaatgcttttgccaattcgacaatgctctcgagttcagcacttcgctcttgattttggcgaatatcaggccgatgaaacttttacacagttagttggacaactgaggggcaccgaaatagcaaaacgtggtttcaagttaccccattccatgcattccatgctcgccgatggccacgtttgacgtaactgtcgatgggctgtccttgacttttctggcaacggcggaggcctctcgttctgcgacgctgtctgaggagattctacctaagcgcaatttctctcttctcgccagagctttaagctcgttctcgcgcttctctaaggcacagaccttggcttggagcgatgcaacatatctagggacgtcaatgactggctttttcaatgagcagagcgcaaaatagcacacttactgtctattgtagtttcccgagccagaagggccagtcacgacacagtcgacgtttgccagctcacaggggctacaccgtggcatctgcccgtcgcactaggccactgagcaattaggtcttcaatgaaggatgaagtatggggcgcgtgcttactttgaccttgcgggcgcggcatcttgagcaggtgggacgcagtaggccgcgggcttgagatgccatcgatgggcgtccagacgtcaatgacgagcgcttgcgttagctgcgttgtgtatgcaaaagatggagggaaagacaacaacgcggagaggcggagagactggagaatgtggagagagcaccacaaaccgggattagtgactgaactgaaccatgctagtgggcaccaggaagcatacacccaggccgaaaaccccggctcgagtatctgatttacatacttgatgttgtcccggtttataattttatggtcagaagttgttgagcacacagatctggatacagtgtctaaattatcccagttcctctatgctttgtcaagtcagcagaagtctctagcggaggttaaatacagagaagtaagcacctctatagtcaagacaagctacaaatggggttaatcccctctaaaatatagccataacattggctgggctagcaattccggcaggcagattcagcggttggctggtgacaaagaacgtccaacgcccaagctccttgcatttcatggacagctgttctagatcaaactgctcgccaattggcatcccccagccattgagaaatacttcatgcagtcgagtcctattcccttctatcaccgccggccatgactcgtacgtattcgaatcacccgccactgcagcgaatcctgcctcccagtgccatcgaaccgactcaacgctgcctgcaactcccatgtatttgcggtcactgccttctcgaagacctagcttgtccttggctggctcttccaatgcgttatactgtagcccgtagccgctccgcacaaatagaatatctccttgctggaaagtgatgccgcgcatatcggcaatttcttgcagctccgtgtacggaatttcgaacgagtcgaatgcatcatacgtcttgtttttggatgctgcgtagtctgcccagtctaagagcacgcccctggatgcgaggggtcgttcggccaggtctagaacgtctaagtcagtaattcatttaagcttcttttatcaggaagtcaaccaactctgtattccaaggcgactgtttttattaggaccggaaacatcgctctgtgtacagttgttgtagaatcgcctcccttctcggtagggatagtgacgagggccatcccagtgggtagatgattgtgtgttgattgtgatctgcgtttcttcaatatttagagaactagtggctctctatatgactatacgattttggcactgacctcatcatcgttggaatattccttgacgataatacggtgtgatagcttggctcttgcggggttcataggacgaataggcacattcagaggtaagctgaggtaacgttagccttcttcatcctcctactcttgcaagactcttcttttctgcgagattatttcatacttcagttgtacaacctcaccagttctaatctctgtttgagcagctttgcgtgtgatgtccggggtaatgagattagttctgccaagctcatcgtctttaccccaagtccccaagccgagtatggaggatcggattcccctaatgggagctcattaaaagagacactggaagggtttctttcttgaatttcggccattgataatgacttcgtagatgtcattgtgaaaggtggaaataatgtcgaggctattcttctctcgctgtgagcctgaaattgttggttttgaatgtgttcccgtcactgctaccgtcggatataaacgagacatgtatcattgaacgccacattacgcatctttctctaaagtagacctagaaccttgttatatcaaccagtgcggagtaactgagtcatgaaccagttctcggaacttcatcgtccactgactctggaagggaataaagcggggagaagctgtccgtgtggacgcaatggatccatcacccacgaccgcatgacagcctccccccgcagtgccccaggttcggtctggtgccgcatctcgcgcgagccaaggtgccgggttttgcggtgcgggcgattaccgagggcaacgcaaaacccaacaagcgttggggaagcaacgaaatgagagccggagaatcgggcaaccggggttggattaggagtaattacttggggttgtttttgaacaagatgtagaccacttctccacagaagcatttgctgtataaatcctacaccgtccgacatttccagggactgatcatcgttggaaacttcaaagtattattttggcgatcaagatccttaagatggcacctagagatcagaaacaagaggtggagatgctcgaggaaagcacaatccagaagccagccgaaatggctacttcagatgttgatcccgttgcgcagaagagcctccttcgcaaactcgactttcgcatgatgccagtcttcttcgtcatgtatttcttaaaccattgtatgttctcccttttacgccactgatttgaaaaggaaatattcttgcaggtttcggtaattaattattggatctctaggggaccgcaacggcctgccgcaagccaagctcaacggcatcacgacgcatctcgatctaaagggcacccaatacaacacgtgcatctcgattctttatgttggatatctcatcgccggcatcccatcaaacatgatcctaacccgggtcaggccgtccatatacctaggcgtctgcatgtgtggttgggcaattgtctctgggtgcacagcgctgtctatgaattacatccaccttctgatgcttagattcttgcttgggtggttcgaggcgcctttctatccaggtgcgatatatatgctcagccgattttatacgaagagagaagtacgtgagatggaggctttactataccctgaggtctagtagctgatattgaataggtggccacacgcttggcaattttgtactgtggtcaactgagttcaagtgctttctctggtctcattactgcaggaatattcgcttccatagatggtagatatggaatccacggatggcaatggtgtgttacttgtaatcaccaaaatgcacgagagaggctaacagaatatgcaggctgttcatcatcgagggtgcagcaacattcgggtttgccctcattgctatctttctacttcccgataccccggggaaaacatcttggatgaccccagaggagaacgcctgcagtgtcattcgaatgcaagaagacagcgtgaaccagctccagcatgagactccgatgcaaggtttcatgagcgccatcaaggattacaaagtgtggctgtttatgctcatgcaaaatatgcatttctccgccatgtctttcaatcagttctttccaactttggtgaaaacactgtgagatctctattccgcctcacacgctctcagaagaatacgtggctgaccaaaccaaacagcggatacaagaacaccatcaccctggttttgacatccccgccttacattttctctgctctgttctctctcgctttggcaagatcctctgggtactttaacgaccgaacatggcacattgttggtggcaacctcttcgccatcgtaggtttcgtactggcctgtgccaccacaggactggcaccgcgctacgcagcgtgtttcctgttcgcggctggatcctactcgactggaagtatcatactgggctgggcttcagccaatgttgctgactctcatgagaagaaggctgtcacgttagccatggtcaacttttctgccgtcgcagccaacgtgtacactgcctacctctggcccgactctgacagccctcgtttcataatcggtttgggaagcagtgttgggttctcgttcgtttgcgggcttgtagctattgtggcatggtacctcttccgacggtcaaacagcaagcgtctgggtgaggctagcggtgacaatgtcaaactgtacgcgatttgagagtcaactttgtatcttatttcatccctgcgtggagtttcagtttttgccatcgcttctaaacacccgggtttgcaactttcaagctgttttgtagaggattgtggtttgctcgtcacgccaaccggcaacactctctgtgcgagagcacctaaacaagaacatcttctaatttcccccatggatcggtgaaaacacggaactgaaagttcacacgcagtaacgcgacgcgatgcgagaatttccacaagaatcctcaagttttgacccagcacatcgttccctcattttttttttcgcacagtcagaaacaaccctttgctgcaacccacatcaaccactcataccgacaaggtatctcagccatgcctgtcaccattcagccacgccctgaaaaggcgggcgcgaatgacgatggcgtcgtgagctcctctagcgagcttcttgtcgtcacgtcgaaggagtggactgcaaagagacctaggttggggcggaccaacaaacggcagactcccgaggaccggccagttctgcgctcttcttttgagaaactcgaagcccctagcgccagaattattccctacagaaacggcctcgttcatggaatcattcgagcgtttgaacaggacctccaccttgtgctccggcctgatgatgtttggctggctattctggtccaattcaacttctaggtcaacgcacatgccgaagaactacgacacctctttgtcactcacaaggagaaagaagtccttgaactcgatacgcgtcccataccacttagggagattgatttccagcacgcttctgaagagttcatcgagcttctggagccctttctcgtggatgagagcctctccgaatggctcctgcctgcgttcaccaccacgaccgcgaacgacaagacagtcgcagccctaactctgatgtctacaatgaagaaatacttcgactatacactcctatgtggcggatgtggtttcccttctgtgaccttggaaggtgagaagaaggactgggagctcctggcagctaaggtccgaaaccttgctgattatggagatgaaccggccgattggtctgtatgcctcgtcaaggtcgtcgagaagatgatcgaaagctttgacaagcttgatgatgacaacgtcaaggatttctggatgcgagcttgccatgctgcgggagaaaacggttcaggggggaccgagaccctatcaggatggcttacagcattttgctactggggggatgatggtaagcgggtatgtcactggtctgatgaaggtctcgaagaattgatgccgaaagttgatcgtctacgactcacccttgatggcattccgttcccggtcatctcccgcggtaatgtgcgtaaggctgtggcagaaatgcccatcgtcgtgaaagactacggcacgctgatggtgcatgaaacaaccgccatcacaggtcagatggcaatgaagggggttcagatggatgacgagtctcggatcacccatgtccagcctatgtctggctggtggatgttggaggataagacatatcctttcacggaatgagtaaagccgccattgatacaagctcacttcaagatgtatcaacaggggctgggaaacaagcagagggtggaagccggttcattgatgaggagaagagggttgtggacggaactacctatcaagagactaatgaaagtactccaaggagtatggccagtctagttcgataaataaacacatcgctataaagatctgtcgcagttgaatgatctagaatggagttgatactcatggacaagtgaagatattccctaagaggcttaccccatcccacggcgacttacaaatactaccatgccgtaaatgacttaataacagcttcaagagagcctacttcttgaaatcgctgacatcaatcttcttgaattgtgtcgaggcttgaggcagtatgcaccacttagtatgtttaactgggaactttgcttggatctatctatacatcaagtgatggggcaatcctctatctctacgttcaactctctatatattatatttgacatggaagacatattgtaatcgacttgaagggtaaccaagaggtcttccaaagcgttctgaaatccagctgctggaacatgttctgctttagctgtgtcctgtcctacgggaaattgccctcaattctccaacttgctgagcaacgagtccagaatctcatccaagtgcttcatggacaaagtcagatgagcctcttcctcaaatctgtggtactcaacaccgggcatcaactcgactgcctgatcagccatcgtaattggaacattacgatccttggcgccatgccacacttccagcctaccatcgatgggtagatcttctagctgaaaatcccaaggcctgccgaatatttgcgcctcagtaccaaatccgccagtaccgtgcttgatggcttctcgcgagcttcttgacaaaaccttgaaaagcttaccatcctctctaaagataacctcttggtcctcggccggccatcgctgaaagcctttggccatcagctcctcaaatttctcagggtgttcggtgtcctgggccgcggcgttgagctccataccgaccatccagttgacaaatccgggcacccagctcgcgagggtatacatgacgcgcatctgcggcatcatgcccgccgtgcccagagcagtgggccacatgccggacacgacggtcacggagcgcagccgctcggcgggcaagtgcctcaaacaagccagcgcgtagggtccgcctccggagattcccaggatggcgaacttctgcacgcccaggtggtcggcgagatgcaggacatcgggggggaatgaggacagtgcgcggccgggctgtgccgtcgagtcgccaaagccgggcctggtaacaccaactacgacgacgcctcgctttgaagccgtctcgtggacaggaagaccctcgctgtgggtgccgggaaacccgtggaaatagaatatgaccgactggtttggggagatgggtgccccaaatgtggtgtagctgagatggcggccatctggaagctcgaaggagaggtcttcagacatcatccagcgtgtcccgcaggttcgacgaagctgatgggaggttgtgagggggaacgctcgagggctatgcacaacaacggacttttgagggaggtaatctcccgacggtttaggagaagtagattgaacttcaaagatgtccaaatccaaccattttcgaccagggtacacgatctgactacgtggatgttcaaaaggtcgtttcaacatgccatgggttcgggaaataatgcctattatggacttgaatgttacgctacgagatatgcgatggactagcccttggtttctactttcctaggcctcaattggtctcatacgctccattgactggttcctcaagagcaataccatttatcggtcgtttcctccagccacctaccccaattcccgacttgttgctttcactttgtatcttttgaaccaccaggctcgcgtatgacattagccagtacggggctacttcctgcttgcctgtgataccagtgaactaattcgtctcaggcacattcaggtagcaacattgtattaagtcttaaatagctgtggaaatcacttgtgcgaccgacaatgtcagcttgtcgactagtatttcgatctggcattggcaatgctgtgtgatcagtgcgttttccctatggaatctaagtgcccagggatggtcccgagtctttctttggaaaagatttcatgatatgatattatcgagcttagttggtgcgggaagacatgaatgataagagtttaactgacccttgagtctcccctggcttgcatggctcttgctaggatttggcctagaccactataactcaaagtgcaggttgttaactagattgctacgcaagacggctttacaattctctgcatgtatgcactgcttacgcctccacgctacaaagacaggaaaaatcttcatgatctttcaacttatccttcagaaaaacaggtcgactcccttcccccgaacgatctgttgaccctaccgtagtaaggagaaggccgtaagctcttacagctttcgtacgccttcgtgctatatctgattgttaagctggtgggtgaggatctacagcattccccaaactcaactggcccgttaattctttcaaacctaattcaactcattgaaatcactgtcggtggtgcccttccgcgtttgccatacacgaaaactcatatccagaaaattattgtcaccactgagtgggtatggcgactctacttcagaccaaattacatcgatgtcactagcataagcaatacacgcggccatgtgggtacttccctcgatccgtctcctcgcaatccaagttcttcctagtttctacctgcccacccagggaacctcgcccaagtccactcggttttttcactgcttctaggcctttgtaaccatttcccttgctttgcgtcttaccgcggccccagccgtcgctgtacacaacattcccgagccagtcagaagcgcaaaagtcgctcaccaaactttaccccgcagaaagactacgctgtcaccgtcatgggttgtaagtgaacagcggaaccatacattgccaatggaatcgaagattggctccattctatgatgatagaacggggcatcatggccatatcgaatatcttcgatatgttgattgaacaaagctaacatccgctgcttaccacaagtctccgatatcttggagcgcttgcaggcccaacctgagagctatagcaaaaagtacagttgaccttgatgcctcaaagtattaagctaacactatatgtaccaacagagcccagtacaaattcggtcgaaccctcggtgccggtacatatggcgtcgtgcgcgaggctgtgggcccaaccggaaaagtagctatcaagatcatcttaaagaaaacaataaagggccacgaggacatggtatatgaagaactgaagatactgcaaaagctgcatcaccctcatatcatcaagtttgttgattggtttgaggctagggtttgttcatcaatcttctcttgcttcctacctagtgcggtgaggctgattgaattccatacaggataagttcttcatcgtcacccagctcgccaccggcggggaagttttcgagcgaatttacacccagggcaagttcactgaaaaggatgcttcgcaattaatcaggcaggtcctcaatgctgtgaattatctccatcagaataagattgttcaccgaggtgtgtggcactctttataaccttaactcgcgtccaaggtggtgagagtgcaaagctaatatctgaaactcttctagatctcaagcctggaaacctgctctttgtcacaaaggaccccgactcaccagtcgttgtggctgatttcggtatcgccaaaacgctggattggcaagacgggcctctccacacactagttggatcttttggatacacagcccctgaaattttaaaccgttcaggtcatggcaagcctgcggatatgtggtctatcggggttatcacgtatacccttctctctgggtactcccctttccagagtgacaatctcccagacttgcttgaagaatgccttgccggctccattatctttcatgagcggtattggaaggatgtcagcgacgatgccaaggactttatcatgagcctcatcgtccccgagccacataagcgtttaacaagcgaggtacgaaaatcgtcctgtaaacgctgagcgatccctgtattaacctagcttccgttgaatagcaagccttggagcatatctgggttagcggtcttaccgctagcgagcacgacctgctgcccgacatcagccgtgctatggaggcacgcgccaagcttaagcatgctatcttggccgtcaccctgaaaaagagaattgcggctctcaaggaagctgagtccgactcagatgacatgggcgacgctgaggacggagtgccttcctctgacgttgagaaaagggacggtgccatgttccgcgaggtcgtcctgggcgcggttcgagacaaacgagcaaaggatgctttggcggcagctggagagcaacagttggaagaagcaaggagccgtagccggagccggagtcgaaactgaacatagtcctgcgtaagaggattatggcaatggcttagaagaatggggctggtctggtatcagtttagtttaatactggactagtcatggtggcccaactatgacagttggaaagaacacttgatgatcgtttgggtaaacagtatggggtgatttctttcagtatgggtccgtcaatattatcttagagtgatgatccctcgggaagctaagctactagacgcggagcactgatggcttgcaggtagatccccctaagctagctctcgtttaaatcgtattcggctctatctcgggcctcacctgaggcttttcatggattcaagatgtggtagctatccttctgatgtttccttctgcacctaccaggctacctcacctatctccgaattacgcatcgtggactaacaattcacgtaattggtattactcctgatctcctacttctatgcaaatccggtcccattgagaacagccaactgtttaccagccgggcaggctatatctgtttctcaaaattacatagacctgaatcgtatatccatgttggggaacagcatgaatatggggacacatacgataagcttggatctaccgtcacgatgcagggacacagcgttaaatgttattagcgcttttgatcctactcctatgtcggcaagattcaacagtatactacgccagcgagaaccgcgaacgaactcggagcagttgaaagacgaaaaaatcaccgcctggatcaaaggcagtacatatcagcatttggaggttcccgaacaggaacagccagtgtcgcagatcaagaaactgtttctatatggcttctctggctgtgggaggacaaccttgactgcatccgtcatagagcacctaatcagtacggagtgcacagagcaacaaggtgtttgctactatttttgtaacagattccatcaaggaaccgaggatccacacaacgtactcaaaacactcatttctcagctcgttcggcaaaatgagtctgcattcgccgttctcgatgaccacctgaacacacgaaaagttcctccggaatgtataaattctcattcatacagtttagaggaccttgagacacttctggggtcaataattcgtcgcttcgaacgcgtttttgccattatcaactcagttgaagttctgttaccggacaatgcggctcgcctcctctcgctactggcaggactttctgacagctcggaaacgaacgtttcattactgagcacaggtgctgagcagccaggtcaacgggaattatcccaggcactgaatttttgcccggtttacgttcagggcagacccgatgatatccgggtatatgtacgagctgagctcaacaggcgtattgaacagggtgacagtgagcttaaacagaatcattttcaaacaaccatagagaactatatcgccgaaaggagcaatggggcgtaggtttcaattaccctcacccttgaagtttaagctcgggctgcagctcaactaacaattttccagttggatttgggctatctgtgagctcgacaaccagtgtcacttagcccttcaaggccgctgggaacaacctcctgccttcgcaccgcttgacacttccgcacatccttaccatacctatgggcccaatccaaatgataaatcatctgctatcttcccctatagacactatctgaatgaagtgtggaagaacggcgggcctcgagcaaatttcattctggtacggttgttaagatggatctatgtcggggcaacaatacctggcctccaactttctatcacggagatgtgtgacttgctatcagtcttgcttttataccaaaagattgaagacaaccctctgggcgcaactgtgactgaagaagaggtaaacaagatcggcgcacaacttatccgcaaggctccggataccttcaccttggagttcagtcatgtcaccgtggaggggtatctcatgtgccacttggatgataacatgaaaaaattcgcccttgagggtcaaattgacagtgagatgattgacgaacttgatatagtcagttctcagctggagcggactggcagactcaaagacgcagaggctatgatgctgaggctcatcccatgccgtgagcaactatggggtcccactggaaatccaatcctcgcggcgtttaacaacctaggtcgtttttatgaagagcacggccggatagaagaagcacaggatgtatatactcgtgctctcaacggatatgaggctgccaagaatccgaataaggagtccatgttcaatacagtcaacaatctaggaatactctataagagacgggggatgttccaggaggctgaagcgttatacaagcgggcacttgtcggtagagaggagttatttggccctcttcacgacgatacgcttagctcgacgcattgtcttgggctcttatacgcaacacaaggccgtctagatgaagctgctcttctctgggagaagtatctacacgcactgcagaaaaataagggggttgaagacccgcagacaatagttgcaacatatgacctcggtacgctgtataaaaacgatggtagaatcgacgaggcaataccactactggaacgagcatttacgtcatacgagcgtaccaaggggcaagatgatccagcaacccttgattcccttgacactttagctacagcccatgccatgaagggccagtacgaagaggcagaaagcctatggaagaggttgctcgaggcccggcagagatcaccaggttccgatttcgacttgatccggacaaaggaaaatctcggtcaggtctactcgcgacaagataggcttcaagaagcttcggaagtttatctctctgtgctccaggggtacaaacttcaatatggatcttctcatgtcgcaaccggggagatgtgcaacacgctggcagaactgtatgaggacatggatctcttggaccttgcagaagatatgcaactacaagcattccatatctttgaaaattgccttggcccggaagatatagcaactgccacaatggcagagaaggtaggtttcacacgtgcaaagcaggggcgaatagatgaagcagctccattctgggagacagcactacgtggtttcgagaaagtcaacggggaagaccaccggtcggtattgtggcagatgggaaatctggggcgcgtttataaaatgcagttccgtctagatgaggctgaagcaatcctcaaacttggcttcgaaaggtcaatgcgagctttaggtccacaggactctctgacacagaagatcggtgaggacttgattcttctgcatgagaaccaagagcaatcagaagaggctgagaaaatatctgatttgctaaagtcatgagagcttagactttgaatacattttgtcttcgatcggaccgcaacaacatgtaagatgttcgatcgaagagatgcaataaatacgcggcctaccgtgtacacaaacacagccttctttatattttggtcattcgtttcaactacaaaaagtcctggcttcttttgttcaccggccggcaaagacggctgtttcattgtttgtcattcgatgcagtcggctagatcggctggcccctggctgacaaccccataagaatagaggctctggggtttcaaagtggccggttcacagcgctaatgcaagcgcttaatggcgatctacagcgtatcaatgcatgttagcaaataattttcaagtcggaaacactgcttctggaaggccatgatgatcatgtaacaccagtgcgatcctgttggtgatgctcgcacctgaggaaaactcacggaccccctttgtcgccagttccaacatataaaacaaagggtaagctgctgaatacatccaggtagatgaaatctctctttattccttcatcgagaaatttcagccgcatttgaatctgtgacaatgcgtttttccaactttatcctcacactgagtgcagcatcttctgctgttgccaacaaattctcctaccgaagccagcacccgcatgcaaggtcattcaagagagatgtctctgtgaagtctgacgatgcttgggatcatgtcgtcaaggggtccgaccttgctgtgtccgaggagtcagcaacagtctcatctgttgacaaatcgagtttccatatttctaatttcaagctccgtgccaagaagcttgatccatcgaagcttgggatcgacaccgtgaagcaatacagcggctatttggacaacaatgaacaagacaagcaccttttctattgtaagaaaccttctttatctgccctgacgttgtcactaatttgctcatccgcgtactagggtttttcgagtcacggaatgaccctgccaatgaccctgtgattctctggctcaacggcggtccagggtgctcttctctcgtcggcctattccaggagcttggtcctgccaagatcctaccggaccaaacaattcagtcaaatcctcattcctggaacaacaatgcgtctgtcatatttatcgaccagcctgtcaacgttggattttcctacagtaaaacgaacgacactagcagtaccgtagctgccagtgacgatatgtatgctctcttgactctgttcttccacgagtttccggaatacggcaagcaggacttccatatcgctggcgagtcatacgccgggcactacattcccggcattggctccaggattctctctgatacgaaccgcaacatcaacttgaagagtcttctgatcggaaatggcctgacggatcccctcacccaatatgcttactaccgtccaatggcctgcggagacggtggctatccctctgttcttgaccctcaaacttgcaacaaaatggatagcgacctccccgcgtgccaggattacatcaagaagtgttatgatggagatgtcgaatcatgccaggatggttttagctattgcaacagtcgactcatcgacccctatagctccactggtaacaacgtctatgatattcgaaagggttcatcagacgtgcccaccggcgccgacaagtggctcaactcccaggaggtgatggaagcactcggtgtggaggttgaaggctacacccagtgcagcaacgaggtctactctctgttcgagcagtctggagattggatgatgccaatctaccgccgcattccggatattgttgctaagattcccgtcctcatttacgccggtgatgctgactttatctgcaactggcttggcaactttgcttgggtcaagggactggattggacaggaaaggaaacgttcaacagcgccaaggttgagacgctaagtgctgcaaatggttcgcagtatggcgaaataacgactgcacagaacctagcttttatcaaggttttcaaggccggccacatgacccctactgctcagcccgtgggttccttggatatggttaaccgctgggtgcgtggcgagtggtggaataaggactaaatattgtattttatctccattgcgactccgagaatatgtgtacaacaattttcgtttcgagctattcataaagtggccactatgcgcttgtgaagactgttttgacccaacgctacctggacacaggtaaacatgaattgtctgaagtatggatacaaggatatgaagtgggtgtatcaagttattctagaagcatctaaataaaccaaggcccttacacttgtacaatcttcgagacaggtttaccggctgggttttcagccctgaatcggcattttaagttgtgcctttagtagctaaaattaggctgatctctcaggcaaaaaattcaaacacagtgaacaatattgaaagtctaggaatatccctcctttaggagtgaaaagagataaacctcacggcacacatgtagatctaagatcggggtgattcatcatattggttgatggaaatgattcaaaactgcgacgagcaggtggagaggcttggaatcaaaaggaaagagtaccagaaacatcataaatagctctcaagtaaagtagcgccgtttttttggtgaagcctgcatccgtacatagttccgtcgagggcgtcgaatccccttcaccaaggtctgctccgagacatgtgtgttttaccatattgaccacactcatacgtgatagcaaaacaatatttagggcatgttcaaatacagtgacatgatggaagattaaaaggaagatacatgttattgaaattatgcgtagttagtgatagagtgtacaaaagacagcttgtggagcagttgagtttgtattttctcctcctcaataatcgttgccgtgctgtcggcaccaaagatcgtcactcatagattctatgaataagcagaggccgcgggtagacgatttatgctcaatctctagtcacctttccttcaatttcctctgtgaagggaggcatggcggcaagagctcacgattcgtccagactttgatgaacatcttgccgatcggtggagtatgtaacgtttcgcacataccggacgaaataaagggcctggtaaccatgtttcggacgactagtctgcaatgcggctagcaatgtgcagtacctgtcgatccgggcagacacgcaatcattcatgcggtgtgggtaactgaatcatgtcccagttctgaagacggcacggtcgattccttgggacaaaaagccccccatttctacacgtattcatcacaggcatgaatcgactctacgaaagttccaagtcaaactaacggcagcgtaatgaagaggaactgacatgataatatattcaagccgacgcggacgcctgtggatagggcagatgtcaccttcttcatcaatgcagtttttccaatatttcaaacactagtcacatgatgtgttgtccagtaggctcttccctcaatttatgtgatactcgtcttgtcataacgcgtcggagtcttctacggaccttccactttcagcaccaggcacataagtcgatttgtagtgggaattacacccttgacccatgccgctgccaagagaagtagaagactttccaaggaaaacagcttatttacaatccggcatttactatgcacctgcatgctacgttacccctgcctgccaggcacacttcccctcatggaaagtgggagttctccttcggcgtctaggtgatctacgaaaagcaaagatttgcgaggatttggaggcttgccacaagactaacacatgtgtaaatgcatgggaactagaagataccccagatagggttcgatctgactgttcccttacccaactgctccatactgacatgttacatgcagtgtgcagacgctctcccctgcatgaagtggcggcaacttgtcagcatttaattggaatgaagctcttaagtgatattgcctgacaccgcgccgaattaattattaattgattcaatatgtacaagccgaaggcaaggatatgctggccgtcgccactgaactgcgtttcagctatacttgcatgttgcaccgaaatctggatctcttggcccgtccgatgtgctagagttcctaatgccgcaagtggatttctattgaaaggtgaaaaataagacaccgagtactgtgcagcttctccagattcactcgggtacctcaaagcagcatcattctcaaagacgaaacacgttcccacctcggcttatgcctcgttgagctgcttcagctcgggtggttacagtaaccttacaaaaggtgatgttgtagatacacgaagttcggcaaagtggaacagctgagagggaacagggtttgtggtcgtttcagcgacggagatctagcccagatgaagaaactcaactggattggcagatgcagtgtcagtacatgcaatgcaatgtgatggcggtagtgtgtggtaaccgtggacatccttgtgttgattggtcggggcggtttctgatattaccgccggtctccatcttccttgagtcaagtgttcggactacgtggagagagagatttcatatgacatttcactttcacctggtggtgtgtcaaaaggtataagtatcgacaggaatctcccatctggctaggaatcctccttcttcagccatcaaccaacaaataagctttccttcgaaaagcagtctctccttcaattgaatctggccattcaaattcgattatcttaccatttgttgcgagtcgacaattcttgtataccccaaaccttcacttctttgattagctttgccggacctcagcttctcaacccatcaatatgaagttcacagtcgctgcctctgtcatcggcctcctggccgctggtaccaacgctcatatggagatgagcaaccctcctccttttcgctctaagagcaatccctattccaccaacatcgattactctatgaccaaccctctcgatcaggacggcggcaactttccttgcaagggctaccactcactcatcgataccgcccagggcgcttctgttgccacatggactcctggtcaggactacagcatctcggtatccggctcagctactcacaatggcggtagctgccaactctcactctcttacgacaagggcagcagctggactgtcatccactcattcattggcgcctgtcctctgaaggagaagtgggacttcaccctccccagcgatgccccatccggtagtgccatctttgcctggtcctggtggaacaaccttggtaaccgcgagatgtacatgaactgcgcccatgttaccattggcgccaacactagttctgcttccacgaagcaagttgacgctggcttctctagccgccccgccatgttcgttgccaacgtcgggaatggatgcaaaactgttgagacctacgacgttgagttccccaaccccggccctgatgttacccgcagcgacggagctaagactaaagcgccttcgggaagctgtggcggaagcagcaagaagatcgccagatctttctctgcataagctgtagatgagcttaagcatgttgagcatgctaaaccacattggttcaaaccatagtctggctggaccacgaacatttaaaccagtcaatggttaaattttgtttatattgctttatgttttgtatataagtcattcgctacgatagatgaacatagtcatgtacgagatggtttccgtcagctctcgaatgccgcaaagagacggcaatacaatcattgccactttcactcgccttctatatctagaaccttcaagtagctctcgtgcatccaatgccgacaggtcccatcttccgtagaatcgtcggcattcagcaatcctagtcaccccgggtattgcatcacttaggaaggtgaattaatcctttgagcctaattacacacaactcgagctacctgcctttttgttatcatcaaacaaagggaccccacatgcggagagtcatggccgaacacaacctttgtccgctttgagttttagccgctgtccggtaactgggctctattgtgagttggttacgagcgagcttcagcgtctcacgactgtttccgcattatcttgtgctcacatgtctcaactcaattaaagaccgaaagacttagcctagcgcaagcgagagaaacaaactaatacatctttaaccccatacattcaacaagtgataacaccgcgtcatctcaacagacttgttcataagagtgtattcagccagctacagatggttcaaacaagagctattcctcgccgagaaaactctggaccgtgtgtttcacacccattattatcatttcattcttcaaaaagcccctacgcatcaactcgaaagtgccgacatttggccgttcgaattccgggtcaaagtaacatttttggattccgatgccatgttcgacctcaggggatgtttcccgaaacggattttcaccgtcaccatacagaaactcattgacctcatcatcaacccagacggcgtatccatctccttggaatactccctcctcttgccagcccatcgtgaccttgggcctgtcagctgggttccgcccacgccagcccagggtgtcacgtaaacgaaagagtagctcccggtgcgagccatggccgtcttgcattttaagaaagctgagctcaacggacctcagcgtatctggaagcagggatagcaagcctaccagatcatccattcgtacactgaaacccgaaagcccacagtgacggagcctcggccagcgctccaccgggaagatgttcagtaatgggatgaacggctgttcctcgccatgatccatccaatcatcaaactctagatcgtacgtcatgttggttctcagactaatgtgctctagatccgatgcctggcttagcgcctcgtgcagctggcggttacgaaaggcgggaaacccaagctctgtctgcccgctgagaatcagggcaaggtcgaggcgccgaaagcctggcttgagcaacaccgtgacgagatcttccagttctggacatggttggtcaaacatatgggcgtttaggcccgtgtttaacagaccaacgtcaaccacaaagtctgtgatgtggtggtccacccgagccagggtccaaaggatgatacggtagcctctccatctattcttctccctttcgtctctctcttctgacgaccattgtgttattctcagcctactaccaggctcgctacatggccaaccacgagggatgggatagttgaacccgtacgggagagcacgaatcatgggagtttggtagagagggttgaactccaccccatgagcggcgggtgtgagggtaattctggtaagcgacgtaaagcgctcgaggccatactggagcgccaaagcatcatccgaggtcttcatgatcgcttgctgctgcctaaaaagctctttgtagtgattccacatatctttgactgggggctgcgcggcaatccaacttgcccgtgcagcgcggtttggggtctctagttcgtcttttgggagagcgtctttactgtttctgtcacagacgtcctgataccattgttgccagaagggttcgatgtgatgggccctgtgccggcattggtatgcaagcggtggctctggaggaggatccaggcgggcgtcgtcccagatcagctcgaccaccttttctctgtagacgtcatggtcggcgatggccctgaagacctcgatgttgcgtgggttcgccgaaagaaagacgcgatcaatctgcagcagcacgcgtcggccgaaaaccgtgcatgtgagacgaaggctcttgcggtcgcggttgctcaaatgcgacgcaactgaatctagaatctccgcggggagtccgagaagcaacgaaggtacaccaattgaacacatattttctctctttttcccagagatgccaccaagatgagcaggcaggccctgtgtttagttgaggataaagagaagggatgcgttcatttgcagccggtaatatgccagaggtgacaaatcccggccagcctaaagcaaggaccaaaaatatcgcgttctctgattggtgctgcttttcttagctattttcaatacaccagctctgaggagctgtcttggaccaggaaatctagagagcgaagcgcaaccacaaggttcagcttcatccaaaggattcaatctggtctgctgactcctcaggacatgacgtttgcttacatcctcaggtggcttttttctttcaggggaacaattatctccaatcatgagcaagactttagcacaatttaccacatcctcactttttcattcgcatcgggtgggggataacacaattcaacaccatagatttgcaagcaatctacctcgctgccgaccacaccaaaattcaaacatttcacaacaactgtgaaagcaaggattgcttgtatactctccttgattacctaggaagcgtgctaattgcatgctgggtttgaattttttttttatgaaatccaagtcatgatgctcatatgttgcatgcaaatagagcggcagaacgggatttagatttaacaggagggtacatgccccaagaattcgcaataccgcattgatgtcaacgctcatattaattgtatagatgaccaagacctctgacttttcatatcatcagcggtcgaatcacttgtcacccccttcttgtcatctacttcgggcgtcttcaaagtgcagacagccggaccaatgacttcaccagcaagacttgttccgtccctcatagtattaggacaacccggagagcatctaacagcaagcgaggttctggtcgggattttggtaaccactgaattggatatgaacgaaaagtcatgatcagcttcgacgctccagagcggtattaagacatcattaacttgcagccgcttggggccaatgccatagtcgactttgtgttcaaaggtctcaaattccacgacacagaaatctgtgagaatggagtcaagcgttcgaagccaccacaacagctcgtggaggccgacggtcgagagtgcaagagtattgataagctccatttcgaattgacctaagcacctactgttttgctctcgctggacgtctgtatggcgaaattccgcggctgacttaagcaatgaagcgaaagcaataagatctgattcctgatcctgtaaatgaggaaaaggccgcctaataatacgcacgacttgttcacttctacaaccatctgaatagtttccagaatcaaatgtagcggcaaacttgactcgatagccttgggggcatgtatctaacgtacagtgtagaaataaaccctgatgctgaaaccaaacagcagcattcacatcttgatcaggaaagcatggataaggctcaaagctatctgtattcttgatgcgtgctttgtatggaagagccctccgtctacgcttcgaccagtctggaatccacgagggatatgagagtttctccgattgaggtacggggccaaattcaaagagatggagtagtagttgtaagctgatgtggttatcgttcaattggtacaagaaacaagctagttcctggtacatttcagtccacagcctgttgtagttaagttcaaatcgttggttgggattgaccagactccagagagcagcgattcgatctttcttttctaggcaatcagattggtgaaagtgccataacagctctaggatgctcagatgaatcgtctgcgtacccaagcttgccaccatttttatagcatagtctgataggtccgtcctttggaaacgaacagcagccaaatgaactgtgcgaaaggggatggactgactgccgcaatgcaccacagggtggcgtgcaaggcaagcttcctgaatgacccagcgacgcaagaaccaaggtcgattaaagaaatccatcatgactgtcaatgcggtgtgtccatcacagaaaaattgtcttataatcaggaaaactttcttggccattgctaattgcgttttccatcgactaaagtcggggatagtgctaagagctctgaagaatgcgaacagatttggaatcgtgttattttcaggccctagccaaatatccaccaccttagcgccttgaaagacttcgcccatcatgggaacctgggtagatttctctgtctcatcgttctggtcgagacaaatggcgtcaatccagagatatcggggtttggtaggtgcccgaaattgtctcaagagggcatccacaacggccgtggttcgtaagtatgagacgtcattatcaccgctcctgatctccaaacattggtagagcttctgcgctccccatgtataggaaacggctgaatattctacatgctgctctaatagtcaatgttcaaagatttggcatgtaagttgagaatcactgtcaatagacgggttcagttcgattagtgttattgtgttgagtgtagagagaggtttgtaagcgtaggcattaaacactggcaatttcaatattgaataactagggccagggagttcttgttcgtaagttataattgaagctttttatgacttttacacaacaatcaggcagtaaggctccctgttaggcgaaaataaggcaccgaggcggccttgcctgggccgcatagggttcatattgcgtatgtagtaatcattgctccatttccaattacccggtcattccttgtttactagatggagtattgtagatgacggccaatgggatctggttaacctaagccccaggctggtagctttattccggtgtggcttatttattcgtcattaaccattaattactgctagctgaacggcagaggactacatggaaggcactcgcatcgtatgtatacttgcaattatagtgtctcgatattcttcgtaccatgcccagccatcagacatcttgcccgaaatcagccttgttgaagtagtttttaaacataaaaagcaatcacttatttcggccgaccctataaacacagcgactgaagagagatttgaatattctagcaaggtagcagtttatgggagggccacatttggactttgttagatcaatgagtactagtaccttgaggtacaagtctggtttgttgtattcctagaaataacccctgttaacatagttatctaacaatgtttgcgacatccttttactgtaatctaagacattctaaagaatagatataggacagctttgagttggcctaggataatattgtcattgtctccgagccatcttgtgtcaaaaggaacgtcccggtaccacaaaaatcttcatgtatctgttattctgttctttgttaaaaaaaaaaaaaaaacaataactagtcttcaacaatggcctcggacattttcattgatgttagttgtttcgacttctgtgagctagctttgcccagatgttagcggaataaaacaaagaaggactgtttatgagtaataactacgttttgcgaccagttaataactatatatcttccagtcttaagtccttctgttaattctttttggtcttcactctgatcattgtcttcgaaaattcagaatttcgatcatagcaaaccgaaacagcgagcgaagatcaggaaagacatagttcaccagaatctcgaatacgccacaatggaagatttctctaagtcaagagcagttccaaccgatcgcgaggaagacgaagagtcggtcgaggaaacgccacccccttcacctacggcgtcaaagcatgaagatagatcgacgatgagtcaacgaatgcctgggtgggctcctcccacgttccgtattcctgatgatcttcttaggtatgctcattcgccggggcccgtatatgcccgtgtaatcaccgaaactcctgacgtgtgctatatccagtacaaacctgaaatagaagcggcaaaaagagaagcggcaagattgaattggaatatgcgacagcagccagtgagcgacccaccaccgcaacataaggcgagccagggaggagagaaatggtataacgaggtcaagaacctcaataccaaggatttctctcagaccgaggcaaagaaggatcattcgtcttcgcccatgttttgtccccctggtgtggcttatgtgggttctcccacggatccaaagccgactctcccttacttgccaacaccccgaagctacattgctgggtctatgtatgcgtcaagttggtcatcgtgtggtgggccgtcgatcagtgcgaggagcagccatccggcctggtcagtgtccagtcgtacggccctgccaaagctgtataccaaaggccatcggcacgagccgtatgagcttggggcaaggcctgggcgagcaccgcgtgcacccagggcacaatacgagccacaacctcgtcataatgagatggcaccagagaccgccgcttctgccgctgagcctacagctgggccagcaccagctgcacccacgctgcacgatgagctgccacatcgtttcaaagaggtggcagcacacagcggtccagctatctccgtgccaaaaccgcggtgcgagtccatgtcaaaggcctatttgaagggccatcggcaggaaccgtatgcgacttcgaaaaggcctagggcaaggccagcaccatctgtgcccgaaatacacgaggacctaccatatcgtgttaaggggaaggcaagagagacggcagcttctgccgatgatgctggcgctgctctgcctattcgggagaagcagccagtggtagacaaggacgaagagacatgaaggcccgacacagaccgccggctcctttgacaaccgctgtcaagagaggcaagagccggggacaaatttacgacttaatgaaggcatgtcaagagccatggggtggtgcgggtggaagcgtgcatttctttcggggagtcgaacggagtttggataaattggattggtttaatgtgtctttttcttttgtttttactttcacttttgctagcgtgcttaatatatcctttctcttcttattgttttcaaatctgcgtaaccctaaccctaatgacgactcctatgtgagagacaatgtgaacgagaagtccttcggggacaatatagtgatgtactaactcagtaacgacacaagtcccggataattcccatcaaacttgaagtgattcgttcggtctcattttacctcctcgagacaagcccaggtaattgccttccccttaacacgatatggtaggtcctcgtgtatttcgggcacagatggtgctggccttgccctcaaagcgttgtccacctaacagaaagtgaagaagtacccataatggggcccccagctgcgaatgggtcagtgtcggctgccgatgaagcgtagacgtgtgaagatgcggcattgtggcacatgcgacaggcggcatatccatgccagacaacgagcgagctggaaaggtggggggatgaggggggattgattgagccgtccggcattacagcatacagagcagactggatttaatttgcctcgctgcttgtccgacgaaagccaagtatcgtgtagacagtcgccccttgcatccgatggacttgagatttctacacgcaactcgggatctttgtaaggatttaaagtcttcggccaacagcagggaggtgctgcacggcccaggatgtgactgctctgttgaaactatctgttcgagtggtagaggagtcatccacgaccctcattgcaatggatgacaccaagaaagccagaagagtgcgagtgttcgtgaccacgtttattcgtctatggtattctaaaaattatcaatattgaatgcaggaatcgctaagctatgccaatgaagggaatcagtcgcacaaaaatcagctcatgggtggaccgcccaagcctctatccagacctcatgtcttgccctaaaacaccgaaccgaaacaaaccgggtgccctcccacctttcccaagttccagactaatgatacccgaaccatgcgcccctctattttcttacagagtcgccaatctcaactggggcggtattgccgggcagttcggtcgggactgtggactgcaactcgcttggggctgacgactgcgcgtatgtccactgcggtgggtacggctggggcggaagatatggctgagggttctcggtcgagccggtcgggggaggcacgtatgaataatgcttcagatggtctcccatgggggagccgtaggacgacggagcctgtgactgctgctctccgtacgcaggttggtattgtacgtgctgtcctccaggcgaaggttggtactgcgtcgtctcgcccggcgcctcaggtccctggttggcattcctccgtttcttgagcagcaagacgacccagatcagcaggccgatgatggcgagaccggccaggccgccgatgatagggccggcaatccatgcaagattctggccgcctccgctgctgttgccgctatccgcgccgtcggtgggaatctcaatcatcgatgttgtagcatctgcggtagtcgaagggagagtactcgatgatttggttgatgatgttgtggaagctttgcctgtggttgtcgcccggaacatgggagatcgacgagcggactgcggggggaagcagaggtagtagctgagggtggtttgctggtcgaggttgtcgaagacgctgtagtaggagcatgtcatggtcgacgtgctgcattgccctcgttagatggtggccagtctactgaatatcgaccaagtcgggactcaccaagttccactggcgccattggcaaacttcatgacggacgagttgacgcatgctgttgggatcgggcttccgttttgcgtgacgcagccaccgacattctctctttgagtccagtatcccacgccgcagcttgatgcgctatctgttcaaggggaaccatggtcagcgcatcctcggtttctgatgctcgtctgttgagtgttttttttacatacaagtcccattctttgttatgtacccgatgaaagctgggctggcgttatcagctctcagctccatggcggcgagctctggtggtgccgtgatggtgggctcaggcagtgccatgacggctgaggcaaggcccagagtgaggacctggaagatggccttcatggtgaagatgatacgaggcaatcaataaccacgatgggtcgaccgccctatctctgggggtgatgaaacgatcaatcaagaaaaatcagtttgagcgcaggaaaaaatccgcggtctgggagaggtgagcgggcacctagattttgttcaacctagagattagccaagccttgcagttccacagatgccagaatactgggacttcagtatgtagcatgtacatcatgatgtctacgcctcatcaatcaggtcctatttagcggccaaaaatgaccacagcacatcggtaaaaggagctaaaagcttggtgtttgaacctgcaactcaacacatagatcctctagaccatattgcataaccgcgaagcttgacttgacacttggattaacaattaattgcaagattttcttgtctttcttgtgtatcttcatccaacacccctgttctttgtagcctctgccgattgtacactcggtatgacagtgatccttggtacccggaagaacctaagatcagaaaactacccgctgatccttgtttcaaagcgctaattaatctaactcgctagggcctggtctggcagtgctctgcgtggcaatgtcttgaaatagctcactagaaggcatcatccctgtcggtgtaagcacttgaacccgccacagccaccatctgtgcccatcaaaaaagtgtcacaagaggcaggacgcattgctgattgctgcatttccttcatgctccacgccattgctgggtcaggtaagctttggcccccaagtgtgcgccatttcatcatcatcatcctccttcttcgttactctggacggccccagcgtctcattggcctgcttttaataattacccagggctccagcctcagagtggcatcatgaccgttgctgtagggcatttgcggctttatgtcagacttgccgatccctcaatcagttgatttgtttttgcgattcaatgacttcagccctacccttcaagacgacccgggcaaccgggctactgaagctcaattgatcaatttaggcctggcaccaagacactcgtctcactggctaggcaaaaaataataatccagtatggcctatcgaagaaggtggttcagagaaactgtcccctgccttttactgccgtgtagcaaaagcacggtccattccatgaacatccttgcccgggctgtggacgccggttaccctacaccctcttgacagatcaaatgttcaacatcgctcaattagttgtgctcctttcaagcttgactttactaaacacgttttttaatcaagcatgtggtggaatccctaatcactggaatatcatggttggatctcttttgatcaatccaaggagcagtagatttgaggcttgctgtagacacacaattagaggcatcacatttgcgttgtgtttaagaacttccatgcatacttgtatatacctatgtagatggtaattcaacctagaggctcctaagcaattcaaggcgtaaaagttaccctttgaactgatatgcctcttttcaattagagccattgaaacaggttgaaggcttagatgcgtgctcatatctacatggataccacgcccggattattctcctagcattttactagacgcagcctcagtgccaccatagacatatttttgaataaaggattctttgtctagacccttcgcggataatgaaaggctctatgaaagcaaatgattctcaacaaaggtgttagcgttgcttcttagacatttgctattatggcataggaaggccgtcttaattgttcaagtaatttcttttttgcagcccctctcaaatgaccgcggaacttatcccagagcacagacgcctattattttatgaatgagcgatgttgcatgcatggttgtcatcaaacatttgagaatggataggtttaacttcgcagatcggacaattacttgaaataaacccatttatcgaggaactcaggttgaacaaaggctacattttgacttgatattactagctatgtttttacttcttcataaggtgtttgttgacgggagtaagcggctcctggccagagagcacagccagcacattttgcattgacagcgcctcaaatccactcttcgtctcaaacgcaccgccagcagtgtgtgccgtcaccgtgacattacggttgttgattaacctcttgttcacatttggctcgttctcatgaacgtccagcccggcactgtagacgtgaccactctccagagcgtcggcaagggcttcctcgtcgattaagccgccacgggcaatatttaccacccgcgagcccttcttcagcttcgagatgcgagaagcatcaagaagctgctgtcctcctggtgtggccaaaacaacgcagtctgcctcggcgagcatgtcgtcaagctcagggattcgacgtgctccgccaatggcggcctcctgctcggcactcttagggaagagatcgtagtaaatgattttcatatcaaagcagcggtatgccttggtagcaatccgatagccaatgtttcccaggcctacgacgccaaggatatggttctgggggttgtgagcacccacaggggcgttctgatgagcgtcgagaaactcgtccttgtttccactgcgggcagcaacattgctccactggatatttctgaacactgaaagaatgtgatagatggccatatcggcaacggcttcagaacttgctgatgcgccgttgcagtagaggatgccggcttccgtgagcagagggatgtcggcccaatcatagccagcaccggcagaggtgaaaaccttcagagacttgggaagtaaagggatcatctcggcatcccagcgacccatctcgagacccgagttccagaagggacggaaaacagcctggaagtctccccattttctgtcccgtagagcctgtagccaggcatcgcgttgtctctcctcgagtgagggctggatgatagtgaaggccttctgcaactccttgtagatgtctgggttgaactcgatgtcatctccaagatggaggatgacgggtttctctgtagtagacgacatggtgttggcggttattggttgagctagcggatcagggatgggatgaccagggcaattgataagatggattcagtccaagcatgagcagataaatcaatcttggaatggttgatgtcgactgaccctggaccgaggatggcacgaggcggggtttgcctgcaaagtcagtttggctcctgactcagaacgtctccgcaactcgcgatgttggcgaccgcgacttagaactcaaaccattctccccactgaagagtcgaccacgaggcacaagcacgagtcaatcaagcaacggcccagcagtcgcctgtcgcgtcgcttgcgctatactgaaactgggtgcaggtccccggcacgtctcgcttcatggtggaggaggtggatatttggtggagaaatgaatcagctgcttctcctcgcatcggcattgagcccccaggggatcctctgggtgtctccaaagggaagggatgtctccgattggaacaagtgattcagctgtctgaaaaataaagactaggaccttactagtctttgatctgttgagagggcgttttgcgtttgatcttctcgattgtctttggtaattatctgccgctgaggaccttacagtgacccaaatcaacagacatactcatttagttgattcttcattcggaaattgcatcaatccatctgtaaccatggcttctgtcactgcttcaaagccctacccccccggcatccatgtccccagtttgacatggttccaaggcacaaacgagcaagaaatcgactgggatgtccaatcaaagcacttggagtttcttgtcaagtctggccttcatggaagtaagtaactttgagggcagtattcttcgcctgttgctgatttgggattctcagtcgttctggctggtaccaatggagaggccgtcactctgagccacagcgaaaagagtgagctcgtgcgtcgtacgcgtgaaattgcgatcaaggctggccgtcctgacctcacagtcactcttggctgcggaggccaatgcacacgcgacgtcattgccgaaactcgcctcgccaaggatgcaggtgctgactatgtgcttgtgctgaccccaagttacttccacttcgccatgaaccaggacgcgattgtgtccttcttccaagaggtgtgtatcccaagtcatttcccctagctgggccagtttgagatatactgatacttaataacagcttgctgatgctagccccctacccatcgtcatctacaacttccctggtgttgttgcgggacttgatctgaattcggagatgttggagactcttggcaagcaccccaacatcgttggagtcaagctcacatgtggtggtattgccaaggtcgcccgtgtccgagccgcattcgagccagagcagttcagcgccctggctggacagagtgactggctcacccctgcccttgccgttgggggtacgggtgtcattaccggcattgccaacctcttccccaaggtaattaacgtctactctactcctccttgcttagcccgacacactggaaccagctaacacactcctctcccccactagtactgcattgagatctacgatctgttccttgctggtaggaccaaggaggctgaagctgcccagctcaagctggccaagatggagtggggttttgctaaagggggtatcaacggcacgaaatgggtgacggccaagatcctaggatatcctttggagagctgccactgccgacgaccttatcctcaatacgttgatgctgccaagcaagactggatcctggccacttgcagtatcctgatcgaggatgagacccagctgaacgcaagaaattgaatagagtaaaatagcaaaaagttatttttgacattagaatgaatacatgaaattatcatcatacgactttttatttattgtaaaaattgacttatggtctgtaagcaagccacaagtgagctacacaggttggcttgtcacttacaacgtggccatgctcaaccgctgagactactccaaaactaagcccttgccttcttatgactctttgaggcatcccgaaccgctttaactccaataatatcaacgcttcagtcccaaacttcgtagttgtgccagtattcacttcgtgttgcatcggacaactcgccaacctggcttaatatgggcctgagtgatttgggctagcgctgccgatgagaagaatctctctccatattatttaatatatcactcaggtagtaatagccgtcgcgacagccaatgcgaattgctgcagagagcccgctgtcggctcgcaactgactctttgggcgaccttcgccgagggcagttttctccatcggaccatcaccatctcgtctctccacacgcagcacagcaccaaccagactgcgggcactgcggggaattctcccattttcttgcacaggtgccccagattccccaattcctggagttcgtcgtcggagcctgcacgaagcagtttgcgccactccccacatggtcagtcagctggccgtttcccacgagaaagtagcggaggtagtccttcgcctgttttgaaaatttctccccatttgcaagcctccctggactgcctgtaaactaggagaatccacctggggagtaaacgtggtcgtcttggaggtttaaatcttcccctcagcccccaattgtccccctccggactctatcaagcgacgagccactctgctcgggaaagcctcttgtttactacttatcttcgtgattacatttaagttcaaagacgatcagaacgaacagtagacatggctccgtcggccaaggaagaggttgtcggctccgcaacccacgtcggcgatgaggaaatcgccaagcccgttcgcaatgagtaccttctacccaaaccagagagcattgcgaacatgagtgacgaagacctgggcactctccgaaagaaaatggttcgcaagatggatatggtcattatgtgagttcctgaagagatcgcagttgtgatactcgctgcaagataactgacagtgttggcggcaggcctatcatgggaatcctttacattctcaactacgtcgatagatctgcccttgcagcaacaaaggtctacggcatcatggaggacctcaacatgaccaccgcccagtttgcgactgccattaccttcctctttagtaagacgaccttcaactaggccttgttgtcctgtgttctaattcgtggcttgaacagtcggttatatccccttccagattccttccaacttgatcatgaccaaagttacacgccctggtctctgtaagtcatcaacatgatccaaccctcgagaagaacgctggactaatcttcttagacatttgctctgccgcaaccgtttggggagccgtcagtgcctctaccgccgccgtgaagacataccacaccctccttgtcgtccgagtattcctaggtgttactgaagctgtcttcttccctggtgtgatttacttcctgagtgcttggtacactaagcaggagctgggaaagcgtcttgctgctctgtacgttttccagatgatcggcagtgctttcggtggtttcattgctgctgcttgcttgacattggatgggcgacatggtattgctggatggcgctggttgtttattgtgtaagttgttgaccactatggatctcggccaagtccaaatgacctctaaccgtatgtttagggaaggagtggtgaccatcggttgtggcctcatcttcgctatgatcatgcccgaatatccccacaacgcccgactccttaagcccgtcgagcgagacttcgctgtgtggcgactcgaatgcgaggctggcgccggtgaagccaacgaagacacgacggctctgggtggtctcaaggaagcactgctggatatcaagatctgggcccttgtctggtgtatgttcatgtctcaggcaatggggtctacaaacaacttcttcccgtctattgtcgagaccctgggatacaacaagatgaacaccatgctgctcacagctcctcccttcatcttcgccgccatcatcttctgggttgtttcttacctcagcgacgtttgtctcccaatccccctgctacggtttatttggctgacaacttgatacagcgcaagaacatcatctaccccgtcttcgtcggccttctatccatggcgtgcgttgcttatattatcccactcgccactaccagcactgccggccgctatgttgccatgatgctcatgcctgcatccagtatgttgatattctcttgattctcgaaggggcgcttgatgaagactaacccgtattgctttagccggaccccaaattcttctgttcaagactctcaacttgcacatggcccgtccttaccccaagcgtgcagccggtgtcgccatgatcaacgcgcttggtggcctggccaacctctggtccagctatctgtactacaaccccccagcatactacactgctttcggaactggtaggttgcgatttgaattttggccaaaacttggttatgtagttactaacagtttctgtctgcagtcctcgcttgcactgttgttttcttcatcactattaccatctaccgctggaacgtaaggagactcaacaacctgctggatggttccccagaggatcagcgaaaggctatgaagagtggagttactcagcaacaggtcgatctcggatggaggtacatcggtttctaaagtggtttcgaaaataccgaaatcgactgattacgacgggttgtgtatttacactctggcctctcagcggcgagctcgacgaattgcataacattgagcaggagcatatcaggggtgtcatgaaatgtgaaagacctcagttataattctaaaatgcgctttctggttgaaaaagacttgaatcattaatgtcgttggtttctggttgttgctgcttcctactataacgccaacatcatgatagaatagtcaagctaggtaattagtacaggttacattatcgcaaaacacgaatcgaaaatatcatgcatcacggagcgtatatcagctcgagtcttcgacgcatcctgacgattctgcacctcatccagcacatgtgccgtgatgctggcgttggtagcgaccttggccatgcgcagaatctgctccttgatccacgccctctccgagagatcctcctcctctgagccgagcatcagtagtggccagagctggctgaccggaagagcggcgtcgggctcgagagtatcgacgaggagcctcgtaagtatccggatcttctccattgcctctgctgtctcctttgacagcggcaggtgcttgaacgccacacgatgtagatgaaccttgctggcgtagtaattcgataggtaggtcctgaatgcgcgtgtgatgggaatcgctaggctggctgagatgtgcggcggtttgagatctcccttgatggcgaggtccatcagcgtgggccgttcgtcgtatagtgttctcagatccttcattatctgggccgcgatccgcatgacctcgacctcgtcctccacggtgccgcgagagcggtgccaggggtcgatcatggagatgcggcccatgtagctttgcaccttctggaagaagatgacaccgggggaatatagcacctggaaaagagagtcctccacgtcccactccttgacttcctctgcgactccttcggcgacagtctccgtctccgaggcaatggctggcgaggggtggacgatcaggagttcgctgttcgaggacaggaagagaccctcccctccggctgacaccgcccttgcatcgaggagtctgatccaggagagaagtctgatctctacggctccaatcttttgcttctcaacctgttggaagatcccgtaggcgcgtttaaggtggtcatgggcattgttcatccggtcctctagaatatcaacgtagcataagaagaacagcgaggcgaggtagacttggcgccggcgggattccgagacgatggatgacgggtccagggaggcaacctcggccagggccgtctcgtagtagtgctggggggagcgcccccaggggttctcctgccgctggaacatgaggctcgagaaggcgagtatggcggaccggaccatggtggagttgttggacatggagatgagcatctggcgcatcgaggaccatcgtcgctccgactcgacctcggccaggatgggcgggacgatggtcccgatgaagaagttgatgaggtcgtggtcctccgtgtgcgctggacgttctgtgagggtggccagctggtttgacccatttgcgatagccccctgctgcggtatcaaagatagactggctgattgtcccccagttggagatcttggattggatgcaacccccctactgttgacacccggccatagatcctacgacgcgttaagtaagcagccatggtcagagcaaatacaaagtcttgggttggcgaccaggtaacctacaattgcacggttcatcgacgctacattcgtagcatggctctgatgactcggctctggattgtcatacggaactgactcccctgtcggctcccacatgaaactcgcgtagtcgaaaagctggtcgacggcgcccgggttctgcagccacggctcatccgagatgttggtggcatcgtcggcaggagaccggaccggcagacgctgcggcggctgtggcagctgttgctgaggctgctgctgatgctgctgctgctgggctgagggcgtgccagacgcagagccggcggacgaggccttcaatacgtccggctctccgacgacgaacctccactgggtcggcgtgctgtacgggggtcgccacttgcattgcagattgagccgcgtgcagtgggagcagcgcggccgcagctcgtcgcacctcaccttgcgcttccggcacgtcaggcagccgcttttagagcgcgctggccggggatgcgcgtgtggtgggagctgctgctgcgacgagggtgccggttggtccatggtgaagactctgcgacatcgaattgatggcaatggctattgatggctcttctctttttctctccagcccgcccacattgcccccagctgaccctccggccagaaactgtcacctggagaatggacatggactggcgtggagaaaaaggggtggggaaacggggtagaaacggacgaatctcatcaggcctggccctgttgcacggtgatttccgactcgcgaggttgaattttccagaaaatgagcattccctaacctctattctcatcgctcaagggaaatgaagcgcaatggggttgatgaggagagagtgttcaattgggagaatcctcacgattaccagcccaatctcccaacgagaaatagaaccgtcaccctggctgtagagacctgtgcctggagcagccttctcagtctctgattctaggggctaagccaggagaattgagtacgtaataacgaaccacttcaagtctggacatcaaatcacgcgctctgtccctcaccaaactcgtgagcagagaggtccctggatataattgatcgtcatgccagtttgcactggaccaaaatgagcacgctttggttcacaaattgaactggcacagcagtaattgaatgacaccagtatgatattcaccacgtctatctatataccttctgtcatctaaaaatccaatataaatccaaatattcccattttcccatcataaatcgtaccccattcccagcaggggcccagaagacctctctatttcctcacagagtgtacacaaagtccgggcgcaagtcaccctcgatccagcgctgctcctccgacaacgctgcccacttggcgtccatcttgccggccttgcggtttgcgttcatcttgcgcagggcaaagtgcatgaagatggtgccgccgagcaggcacacgacctggtacccgaggacgacgccgtgtcccgtccagaagtgcgggctctcgcgggtgaggtagatgttggacgagacgacaccgttgaggttgccccagcccacgaccatgccgagcacgaaggcgcgcttgagggagccctcggtgttattgttgagccacgataaggtgttggggatggtcgggtagatgcccgcggcgccgaggaaggtgccggcgtactggacctggaggttgttggagccgaggagcatgacgaagccggcgacgccgatgagcacggtgaagacgttgcagtagccgcggtagcgggtgcggtcggcgaagaagccgatggcgacggtgcagacggcggcgacggcataggggggcacggagaggagctggccccgggttcccgtgtggcccatgccgcggaggatggtggggaggaagagggagaaggcgtagaggggggtgaggcagccgccgtagatgaccatgtagccatacgtcttccagtccttgagggcggcgtagatgtggcgcttgtcaaagtcctcggcggtgcggccctgtcggtccttgatgaggcggcgctggacgcggatgcggtcgtcctcgttgaggaaggaggccgtctcgggccagtcaaagaccatccaccagcagaagacaccgacgagggtggtggcgagaccctcgataatgaagatccaggcccatccgggcaagccgccgacacccttcatcttggcaatggcggcggccaggagaccaccgaaggagccggcgagggcggcggcagagaagaacagggaggagcgcacaccgatctcggaactcttgtaccagcaagagaggtagtagttcacaccagggaagagaccagcctcggcgataccgaggaaccagcgagcagcaaggagacctgcgttgttcttgcagagacccatgagggtcatgatgataccccagacgacgatgataccagtgaagaagatacggggtgtcaatcgcttcagcagagcgttggtgataggttcagcgacggcataaccaatgaagaagatggtcagggccatgttatagtttccttcgaccatccccaggtcaagttccatgccctccaaacgagcattgccaatgtttgttcggtcaaggaaggagaggaggtacagcagcgagagccaggggataagccacaagtcgacttttctcatcagcttcttgtcctataatcagcgaaagagagggcaggttagcgcaagctcggctaaatgcggtagggcagtatataaggttatggggaggggtaagaactcacaatctccttgcgctcctcgtcggtcttgccggcatcagggtctggcaggttagccaggagctgggcgcgctcatactcaatgccggacttgtcaacatgtgatgagcccttttccagctcaatggggagctcgggcttctcaatgtcacccatggcggtagacgtccctcacgcttgtatagcaaagcagtggacgtgggtattgaagggagggaggagggtgggctgtctcggtgcacaagaagggtgaaaacgtgggagagatggagaagtttggggagaggatgtgacggagagctcaagcaagaaagtttgggaatcgtccgagtttttatttatgatgtttgggcttcatggctgagggtaactctctgactggcactctactccgcatcggggggtggggggaagacaggacaagggaaaccccggctgaaccatggctggtgccacttctgtttgcatttattggccttaacacccccatgtatgcctgttctatgaaatgtgacgctctctcgtggagatggttggcttcgttgatgtggtgggaccgtcggttggtcatcaacccgggggcagtcgaccattttggcggggagccccgtaactccgacccagagtccagatcaggttctcagatagagtctatggagaaagaggggaggatattccaaggatttgccccagtcttccagcctgccccttgctcctttcccttgcagtgctgacggattcatggttcgcgtcacgaggaagcttcactgacacaacggaaagagcgctaagccagttaactatgctttagaaaccgcaaagcgcaatgtgcctggggaccgcaggatccgaaaacaatgcttctgggcgctttgcggatccgatggtgggtggatgaaaaaaatggtgtggtggaccaacaataagctaagcaaaacaaatcactcttgaccaaataagatttttaagcatctcactgattagcccgccgcgtctccaacaaagcctgctagggccaagactttgacagttaacctcggggttagatgggaaaccaacatatacgctaatcatgaaaggggcagaagatcaacgcaacaggcagcaggatttgcaaccccgtcttttttcttcactttggcagcgtcacagtcgtatcagccagggtccgtctccgtgggggaaagagagggaaccgggagcgagccggtgagagctggctgctactctccctgcgtcaacagagcgtgctgcccagtgctttttcccttcacccgggcgttgccagggccagcctgaatcaggcaggaatctacgaatctgacgtccccgcagattcacaatgagggggagagatgaggggatggggtacataaacgagcgagacaattaatcttgggcggatcccccgtccattcaggctgcccagtcactgcacgcagtttctcttggtggcacgttttccccccatcatcatgcgaggagccggtccacccctgccgccggtgatgcttctagattccggtgcggtcttttttctcgcgtacttatctcgagggatatctgagtatgtgcatcagccaccaccatctctgtgcttatgctgcgtgggatcccatcccctttccccgaatatgctcttcaatccagtcctctgccccgagaagtccgaggatggagcaaagattgggcaagaagtggcaatctccaagtgaaatccccaacctgtcacacccagccacccctgatcgagtcgactgtcccctcatctcctctctgaacccatacccaatcccaaggcttgctcccttgtggagcccttgaccgcaccgcagagtcggagatttctatctctctcctctctcctctcttcgcgcaacactctattcccccatagcttagcctagtcccatcctccccggtcatgagctaaattttagacgaaggatgctagaaaaccccatgacatgatctatcttgttaaaggaaaaagagaataaaaaagtggcaacaccatgaacaaggtgtgtggatggatccgtcttcgcgaacatggctagaagcatagccgtgcttcggctaaccctcaacatgcattggccattatcacgcacgctaaagcagagtgaccccgaggaagaagggtgtgtcccaagtcagaaaggtcaccttctccaactgccaagtgactcttttgggtaaatcccgacgactcttaccaatctcaccatggaagaggacgatgaccattcttctcaatcacatcaaacattacagattgcaagtagaagagagtgtgattgtagtaaagaagcattctcattaagtctaacatgagcgacagacttgactattcattcattacaaattggcatttcatccagaataaaaacacagacaagcttcccaaactaatgctggcgatgcagccttgttcccttcccaacgccacgaaagcaaatgatgattgaagacaaaaaaaaagaccatataaaatgagaaaatagacacagagaaagggaagaagaaaggataatcccagctacccaatctgtgtagcgataacgcgtatgcccccatggacggcctccaacagccaagagatggggttcatatcacatcacacccccagttcaaggcgtctccctcattaccccactaactattggagatggggatgatcctgtccaaactcaccgccaggcgatgctagatcggacatcagcctttcggttcccaccagcgggcgtcgacccgagaccaatagtcacgcgccgagtctcgccagagccgtttccagaacgtccattatccacccggaggctgccaccaaggttcatgcgcctcgcctgactagcgctgagggccctctcgcctttgccatacagctccgaaggggagcacgtcagaggtgggctcttgcgtcgctctgagctgccccgtcggtgccgcgagatgccgttggtgctgctcgccaggctgccggaagcaggcatgctaggcctcggggctgctcccaatgatcgttcaccactcatagaaccaatcgacgatacacgccttccgccagaagtcgccgcgccggccataagactcacccttcgcgccttgttggccgagtgcagcgcgctcctaagcttgcgagcatcaatggcgcctgattccgaatcggacccagactgctgcgacggcgggttgttctcatctactatgacctgggcgatgcgctgagagttcggcgagaagcgcctcgtggcaatcggcagctgcccctgccgcggtgaaaggttcccggttttagcgacgtcgagtgaccgcagcggagggggcgttctgtctgagtctgaaggggacatcgagtgtcggctcgcaagattgagactcatcgtgggagcctgttgcgaaggagagccgtctaccgccaaggatcttctagatgccttggagaggaatccggcctggaaccgactgggcttggcaacgggaatgctcgtcatttccggcaggtccaagcttgttgaggtactatcctcctcgtcgatcgtgggttcgtgctgcaaaaagacgggcgcggctggcgctggctcggcaacaattgagggcatcgtgaactttggtggcggaggaggagtgtgctccgcggcggcagcctcgcctggattctctggcggagagctgaatttcttaggcgtcttctcaaagtcggccagtgtgccatcctcggattcgtcgtcgcgccatcggacacctcccttcttcatgatggccttcttcacaggggagaaggagactcccacctttgcagggtttgcagccttacgtcgtttcggagacgccttcaatgggctcattgttgtgacctcaatttgtgtcatgctagggaaaacaatcggcttcacggcggaaccaggagccctcttctttcgtggagtgcccttgcgcatcggggggagcgcatctatcacaggcaagggtccgtccggcttgactacctgcgacgcggcattgaacccggtctggaggagcgaatggatgagccctctggcatgagccacagccgactcctcgtccatatcaagggtctcggagagcgaagccagcatctcgaactgggcagtcaggagaagctgcatcatagcagcgtcgcctcccctttcctgctcaagcacctctctgtagctctcccggttgaagttcatcttgagcagctcagcttcccgttcgaggttggcgatctcaccggtatccgcaccatcagtactctcgagctgcttgaggctgtgcacaagcgctgtgtcaatagctcgttcccaggtcggcttctccagtttctgatggagatgctggcggctattctcgagctcaaggagaatgccactggccgtcttccggattgccacaaggttgggtggcatcgcctcctcatcgccaccggtatgctgatcgcagacggtgtcgaatgccccgatccagcctgacaagagactgatacgtcgctcaaaggccctcagcttcttcatgcagttgatgcgttcctgacgatcagacgccgaatggtcataggcctggcgaagacgctgcatgccctcgcgagccaagccctggcgcttgtcgcactgcttcttgaatttggcaaagaagagggcctcggcatccttctgctgtgctcgcaactcgttgatgagcgccatctgttcatcgatcttgaccaagaagtccttgacgtgacggttgacattaaatacgttgcgggtgaccttggtctggatgttcttggctcggttggcatatcgtagagtgttatgggtctcgtcgtagtgagcgctggaaggtgacacgcagacaatcatgacggtcttgcagtttcctccgagcgagaatttcagcagacgggtgagcttgctgttccggtacggcacatgggtcttgaggcggcgatcgcagagggcgttgatgcagccgcccagagccagcagagacttgttgatgttggcaccctcggtaaggcgctcgccacggttcttggtcacagaggctctctcagaccctgccaaatcgataatgctgagagttgccatggtgtgtggctcgttgacgtctgcgttcctgtccttctgggccacgttgatttggagcacggcgtgcgatcgcgaggaggtggcattggcctctgtgggtgacactgtgcggtattcgttgccctgaacaatcatatccatgacctcttggacgtctttgggatggtggcttgacaagccggagactgtgacggcttggttgctgtcctcgcgcagcatcagaccggccttgctacctcctggcaccagcagatctcggatcgtttcgttatagatttccaggtagctcagactaagctctgtggtcttctcctggctgcgctcgtcaatcttctcgaacaactcctgcatggtcaggaagatgatgcccggatgttgggatgtgcctgtgatggtgtgtgtcttgccgcatccggtggcaccgtaggcgaagacggtggcattgtagccgtcgaggacgctgtcgagcaggtttcgtgttgtgccctcatagacgtcggactggcttgtgtggtcatcaaacacgcgatcaaaggcaaagacctggtccttgaccttcttggatgtgggcacgacggatcgggagaatttctgtacggggttgtcttcgggaggatcgaatactctgtagatgggatcccggttagcactcggtgccttgagttgaggaagggtcactaaggggcgagaagcttacaggcaccggtcgtctacgaccttgatgacattgcgcaggccgcgctggtgcagtttgggtgctggggcgccagcgagcgaaccgtctccgaggaagactgtgccatcgtcgtttctctgactgtgaagattgagttgagcgttagctttgccatggtaatcaagcactcgaagccgccgaggcttgtctttggggggagagagcgcgggaaagtcttacagctgtgcagcttcacggatggtaaacggccgtactcgcactggattctggtcagcctcggcccctcacacttgctacctccatgtcctagacgggattccgtccaattcgtcgaggcaaaaggtgccaacatacccgctactgtgatggaggactgtccgccagcttgcgccatatttggcagtgtgaaaatgtggtcgtatcggtgtcgatgcgcttatggttgttcgtccaccgcccacagcgacgtgaggatcgatggatctcctggcagtgctggtcgacttgcgtgcctggattgcgaagctgggcgagaggcagcagactgttggcaaaggcggtaatgtgtgtctgtcgttggtgccggtcgacttcgtgatggggatgcaataaacaagcagaaaaagaatgcttgtgcagcgcagaaacagcaaaatagatgctcaagaaaaaaacccaaaagacaacaaacaaaagtgagtgactaaagggattaaggacagagagagagagcagccgtgcaacgcgtcctgggttggtttgttgatacttactctgttgcaggcaggaggatggacgaatgcacaatgcaaatgcagctgaggagacgggaagctagctcgactaattaacgagacggcgagctggagagttaatgcctgctgcccccttcctcggcggctttgatttttctccaatagatgcttttagcggcatcgacaagggtcaaaaacaacaaacgtcactgttgtgcagcgttgcctggacaaccacgtggaccctcttagcgcctttgtacagcgctgtgctctagggcctgcgcgctacgggcaacgccattggacagtgtcacatgttctgaaactcgccaacctcaggccccagcacttcatgtccgatattttgccggaagcgattagataacgctctcaaccccgctattttatgtaatcgcttctacggtgtataaaccaggcataaacataaaatctgcataaagaccaccatcttgtaattaccctatacttgacctgggaacaatattttggctgcatatatagaatgcctcgataggtacgttgacaataaagccatggcgtaggccgatatgcatccagatatcttctcctaaactatcaggcgaagtctcttcgaagcagatggtgggatcctgagcttccaagttgttgcggtggtaaattgtcaacccctgtaaatggttccattctacctcctctgaagcaccctcgtcatgcagtcatccaaccacgaatactacctgaggacttttgcaaaagagtttctgtacattccatgacccatttaactggtgcaccacgaggagcgaccttctgccgatcccatcgtgtcttgctatggctcgtggaatcaagaccacaacccccatcttcattgacgatatctgtgctgtctctgccagacccctggccgccgacaaccagcatggcttcgtggcaggctcacacatgcccctcagacgacacatttgggcccatagttcatgggtgtcgcgatgactttgatttcacgctcctctttgaacatctttttttcaccattgtcccatgtacagtattcatctttgcttccgtttgcaaaattacacaattatgtcgtgtcgagcagatcgcaaatagaaaactactccaagggatcaaatctgtaagatagttgggcccgagttctgcattgtggtatttctcatcatttgacaggtagtccacgttgcacattcactccttcgcctggctattctacataattttagtaaaaccactgccatcggccataacagtgcgcgccttcatattatcggaataacaggtgcaacatgtgccctccttgccgctctcacagctctcattctgtcatggctggcgcactcacgatgcctgcggccttcgttcactttgaccattttcctttttctcacatttctcctcgatttagctcagtcgagaactctcttaaacatatcaccatcatcatggggcatcgggtacatattttcctccgcaacatgcgttaaagcactcgctctgttgctggagagctatcccaagacccgagtatctggagcaaaacagcatagcccagagccaactctcgggatattcagcaccatgacttattgttggctaaacccgctcattctacttgggtcccgaaagctccttgggatcgctgatttatacaatttggatccgccaatgacatccaaagaactggatcccaagttctgggtattttggaatacctcgagtaattggaaagggaagacccgattgtttgttgcactttggagggcgatgaagtgggaactgctcgcgcccgtgataccacgactcgcaaggcttggttttggcctttgccaacctttcctgatccaggctgtcgggcacttcctgtccaaccccaagacgtccgagtgggcacgagaaggtagagcactcgtcggcgcaactggagtgatctacctgggctcggcagcctctctgggattgtatcaatactacaaccagagggcaagcagcttccttcgtgggcttctggtcgtcggaatttacagaaagacgacagagctgaggctgtcctcggatgacagcaaggcatctctgacattggtgagtgctgatgtcgaacgaattcagcagggtgcccacggattccatgacatttgggtaggttcaatatatctcccgcttgcgcagatgtaattgacagtcgcgtaggccagcataatcgagttcttcatagtcgcttgcttgctctaccttcaactaggccttgcgttccttgtcccaatcggtgtggcgagcatatgcttcctcatcacagtgggcattggtaaaactgctcctcgactccagagagcgtgggtggacgctaccgaaaagcgaattgggatcacggcaactcttattgagaacatgaaagccatcaagattatgggcgtgaataaacagctgggcgactttgttcaggctatgagggatgcggagataaatgcgggctcaagtttccgaatgacaatcatctattccgtaacttgctcgtacgctcccatgatcctttcccctctcctgacattcgcagcaactagcagagactttgacaccacaagagcatttacttcactagcatttatcaggctgctcacaatccctctgggcaagttgtttcagcttctcccggctctagtttcggcaacagcctgcttcgacagggttgcttcatacttggaggctgaatcccgttcagactaccggctgagatcttttgtgccatcggaggtaccaaatggatctaattctgggcgcccaagagatgatgatgcccgaaataatgaacatgcaacagcgtccccaaacgcaactcctgccttttctatcaaggatggctatttcgggtggagagacaacaacttcgtcctgcgccaaatcaatctgtcaattccacaatcaaaactcaccatggttgttggaccagtagcctctggcaagtctacattctgcaaggctcttctcggagaggttccttacatcaaaggaaacgtgtactttaccccaagactttcgaaaatcggattttgcgaccagtcaccatacataccaaatgcgaggcttcgagatgtcatcgtaggccacggtgactacgacgaaatctggtataaggacgttctcgaagccacggctctaagttaagacattgccacttttgctcaacgggatcaatctgtgactggttcgaacgggtgcaatctgagtggagggcagcgccagagagttgctatcgcgcgtgcactctatgtcagaccatcggtgttcgttttcgatgatattttcagcgcgctagataagaaaaccgaggattcagtcttctcaaatttgtttggacctaatggcttgattcacagactgagagccactgttgttctttgcagtcattccactaagcacctggcctccgctgatctaatcattgccctcggagccgatggcaaggtcaaagatcaaggaacgtaccaggagcttaaggaaaaccaagaatatacgcactctctggaaatagatgagactggaaacgccagggatgaacctagcggctccgaggctcaagaatatgacgatatacatgtcgcacagcctgattccacaccagagtttgaaatcgatgatcgtcaaagggccatcggtgatttcaccgtgtacaagcgttatctatctactcttggtccagtgctgctatgtctcttctttctcttgaccctggcgtacagtttttgtgaccaatttggaaccatttggctaaagttctggtcagattacaacaccaatcaccccgatgataaatcacaatatgggttttacctgggcacttatgctctgattcagatatcttgtctagcctgcatgggcggatttaccgctgtaacgtgcatccagttaatcaagaactctggccatctcttccacttgcgagccatcagcacgctgatggctgcgcctttaagcctattcagcatgacgccatctggtatattgctcaacaggtttgcacaagatctcaatataatagatactgagatcgaagaatacctctcagatcttgtcatttgtattgagatatcttgtgctatggccatcatcattgccacagcgtccccatatgtggcactgtcatatcccttcttgggggcattgctttatctacttcaaaagatatatttgaaaacctcaaggcagcttcgcttcttggaccttgagaccaagagtccaatattgtaagtttgagatttaccctcaatcacccagccaaagctgacaaactgctagcacccatttgctggaaacactttctggactttcaaccatccgggctttcggctggaataatgcccttgcagccaccaaccacaccctcgtggacaattcccaacgccccgcatatctcctagctcttatccagagttggctagctgtcaatcttgcattaatggttgctgttctggcggttctagttgtggctctagtcacggcctttcgagcagacgtcggtcttgctggggcatctctagttttactaatgagtttcggtacccttctctcaaatacagtcaacaattggacgcagctggaactaggtatgggtgcagtgagcaggatggaaaccttttgcgagacggtaacgaacgaaagccagggcgatgcgactgatactccgtcaaaagactggccacgctacggagaaatcaagatgaaagatgtttcggcttcatacgagtatatgaaacattcgagaaataccttcggcgatcaaactggtccctcgattaccggaaaccaggctcttgctgttagagagctcaacttcaccatcaaagccggggagaaaatcgcagtggttgggcgcacgggaaggtgagtgcttgcagtataatccaatgatacaagtaatgcactaacactagaaaagtggaaagtcgtcgattgtactccttcttctacgcctgcttgaccctctgccctccgacgaccagaccattacaattgacgggctacctctgagcaaagtagatcgtgatactgtgcgctccagaattattgcaatacctcaagataccttcttgcttcccgaaggaacctcgtggcatgtcaacttggacccatatgcggtcgcttctcttgacgagtgcgagtcagcgttgaagcaaatcggactgtggaatttgattctcgggcatggagggctagaggagcccatgaaggcggacttccttagtcaaggtcagaaacagctgtttggcattgcgagagctgttcttcgtgcacgcgttcgggcccgacagctctccatgcaaggtgttactgataccggtgcgacaagactgggtggtgttgtacttctggatgaggtgacggcaagtgtcgacagcgccacggactcgcttatccacgaaattatacatcgggaatttgaagggtacacagtcttagcagtcacgcacaaggagcgaacactacaggatttcgaccgggtcatggtattggagaatggtgccataaaagaatttcggaatgtggctaagttgtgaaccgagtatggcaggtttggaaaacaagttcatttcacgttttggtttggatttcttttgagactgcaattttcatgtaaaaggatcaactatctgtcatgcttgcaatttatattggtattgagagcaaaagaaaaagaaaagtctcggatcctaccaatactttatcattctgtgatccggtgtaagccctatagggataacaaccaaggcaaattccatcctctagctcattgatgattcaaagagcatccccacgtatacctcttcccgaaaggatggacgcagataacgctacaagatgatgagacagccgctcatggatggtggatgagaatcgaagaatcctcctgggaaaaccagaactccttcgttcctccgagagccatacatacccaaatatcactctgagttaggtgtgtacgatgctgatgtttagtagaacaatttccgctatcgagcttatagatagcacgcattgaatttgggagcttcgatatagattgccaacatagacgggtaggtttgatgtaagtctggacactgtcaaggccgattcgacagttccccactgcacgttgtgccccgttttcgtaatgaaataagatgcctgcgggtgtgcctgtctttatgccttcaaaaatttcaatgcatgcgacagactcgagtgaaacagaagagaaaagtgctggaccacttggaatgttggaaggtggagcgtccaaaaaaccaaggactgaatcatctctttctggggcaaacgccccaaagaccgttatgggaccaaagttggtgttgttgtgtattagcagctttggggatgatggcacaagaacaacatcctgatatctatcactagctggcagtggtccaagaatgatttctccggccagcttggtgcggaactgtaaacggttagttgggtgagcttcagcatgcagatgtagaggctgcaaatgtgcttaccataaagcaaggcatttgtgacacggtcctcccatccacaattttcagacgtataccaaatgatatgatctcatcacctctgggcaatggaagatacacccaagcgagacttgcccggcgttgccgcgagaatcggttaaaagttttcgttgcatctggagaagatggggtgtgtggatgtactgcgtatattttattgtgggagaagaaaaaggtgaggccagtgactacgtgcaaatcgattgtcgagaaccgcatggagtgtccaatatgcccagagaacttgcagtcttctaacaggggtgggttaggcatatcccatatatggaacccatggttgatgtccggcgtctctaggcgtaagatgttgtactatagcacaagtgttagaaacaaagcaataggcgcaattcgggaccgtggggaggctcaccttgaactgcgcaatgacactttgaataaggttcgcgtcctggatggcaaattccatggtgtctgaacgccagtcttggtatagtggcttgctgtccagcctttctactcgtttcagacctctacaatcactggtaagacgtacaataggtggcccttcttcatctgaggtaaatattggggcgcttcctctcgtccatgccagcacgttgctgagaggcaccgaaacatgggacgagccatcggacgaatcttccccagaaagatccctaataaaactcaaagcggagaggtagagccaaaataaagctgactcggagctgtcttgtatcatgtctgtcagctctcgcggcagaagcctccaggcggacagcccgagcttgtccgccttttcgtgtacaagctccagcgggcagtcggctctcccatcaacacgagcattcagggcaaaccaccacggacttcgtgataggaccgctacccacagacgatcgagcgcatcttcaagagcacactctcgctgaaacaatacgaagcagtcggagtggacaccgactgctctgctagcgtgcttgcattgtgcacacttgtggcgccagcagagcgtcctcccgtgataattaaaagcaacctcgttgcctctgggaaactctgcgcccttcaggcacgggggagattcaggtgagagttcgccccctatcactgttgggattaagaacgagagtcagtcactgagttgcagtttagagtggatagatccggcggtctgggatgggagttggctcacacggtataaagcgatcaccagcgaccagcgccctgccgcaaatgccgcactgggcacggaagcaggcatgggcagccatgtgggcgcttgatgatcaggaacaatgcgaccaagtttgaagatgggatgatgaggggggagcgagggacgacgagcccaattgcaagattacggtgaaggactgactgtcatcgggctcggaacatcaaagcaccgatgtgtgttttgcaggaggtgtgtcgccatgtttctgtcctgtcatgatgcccatgtcagcacaaagtcctcatgtcagaaacgaatatcatacgctgcattgggggtgccccgtaattgttgtaatcacgatttccggctgctgcttgatgttcatgcatcgttccttggatacgtgacattctcatcccagcgctaccctagaccgccttacaaacccgaacacggtgtcgacgacaaagacggtgaagccctctcacacctcatgggggaaccagtcggtgtgtgtcgccggtagccaatggctgtcgttttccagctccagcatatcgaatcatttttggttctctgattgaattgatgcttgactggagatggtcagacgacacactgacatgcctttttgatatgaaaaggcggcagaggaaggttttctctctccgctccttcatttgccaagtagcataagcataagtcagctagtttctcgcttgccaagggtcactgtcttcctccggcaaccggcagcaagacaagacccgcctctcagtcagctcatccactaacacatgccagtcttggcgaacgaagtgatgtgtcaagagctgacaacgagatcaacctcactcacccgtgacccaatgtattcctcgatcgatagtgggagtgctaagctagctcgcgtgcggtgcgattgatagaccgtgccttctcatgcaagctcatcgttgttacgttccacacataccgaccctcattcaatcgggacacagcgtgcttcccgtacctgcagcatcaagcttaaccgacgcctggatgggcaaagcatgttgaacttgaaaagggatggtgcatgctccactggcccatggccttcgcttgcggcggaatatcgtttgtcctctgttggcaacagacacggcttcccttctaaggactggaaccttggggcactatcgattgaccggtcgagaccgttagcgtagccaaatgcaccgttcgccacctcatacgatgactagggtgcttgatcttatctgatcttgcaggggttatggtctcgtcgatctggagtcgaactcttcgtttcagttgacgaatggcagtagaagccagtcatgtttacatagcatagagctggacaatgcctgtactgaagagaagggccccaggtagttcatcacacccggaaactgcggatatggttcatgcaagaggcaaagtaggaacctgcgtgccaagctcagctcatgtgctctgatgctcgcaagatgcaaggtaccttggaattattgggtgatgcgaccttagatcggttgccaatgggagctcgagcagggaaaaatcttctcgtcgaggtatggggaaaccaacagaagaaaccaatccaatttcctacgcgagccacatccggctgggcatccagggctgttcggctgggtcactggctcggcgacggccggcctcggatcagataaactaagtgtataatcagattatcagatcatctgataactccactatcccggcttcttttgtgcgtggcggaaccgatcaagcatagcgtgttggaatatcacgcacactagactctcagctgccttgtggatctaattcaggtcatcatcagggccaaggttccgtggagtcctgttttggacatcagtaatagccattgcactagtagtcatgctgcatacggagaatgttgaggtattacctttacggggagaaagaaggaagtgggaggaggagagcctggccgtcttgttcttaaaaagagaggcttgacctcgcctcggctgttccccatcctctaaactcaccactcgcttcatctgtctttcgttcgaaagtttaaccaacagctaataccatgaagaccttcacctccatccagctggccgctgccggcattctctcgctggcctccgtggctactgctatcccggcatgcgctgtatgatgcccctttctcctgaccctcacctcagaccaaccaactcaatgtctgtccgtcactggcagcaagatgtcagactgttgaaaatgattcaccatactaaccagagttgttacgcgtgcaggtcaactgtttctcaggcgtcctcactgagcaccctcccctgacctgcaccttgcccgacatgtattactgcttctgcgccttacctgatctccagggatacttcatccaatgcgctcgttccacctgcgctaatgacgcttccgccggagaagccatccagtttggcgttgatctgtgctctggtatgttgtattctctcgcctcaaggaaggtaattgactaaaatctgctcccagagcttggctacaccatcaccgtgccacctgcaactccatcggtatggaaactcttcatttaggaccttgacccagttgtgtgctaactaggtatgacttagaccacatctgctgtagtctctagcagcagtgttgtccagaccacctctgctgttgtttcaagcagtagtgctgtccagagtagctccgctgttgtctccagcagcaacatcgttcagtcgacctcttctactcagctacccggctcaacttccgctgctagctccgcagttcagtcatcctctgctgctgcctcatctggatctgcttccgcctctggatctgcctctgcttcgggctctgcttctgcttcccgaaccccctcagcctccggagctgcttcctcctccgcctctcgatctgccggcgcatcatcccagggtggctcgagcaccacccctgccaacgtcacccctcagtcgaccacaaccaaggccgccgcgcccaccacccaagccggctccgacctgaccaccaagaccatctacgacacccaagtccagaccgtcacctcctgcgcccccaccgtgaccaactgtcccgtcggccaggtcaccaccgtcgtcgtccccgtcaccaccacggtctgcccggcctcggagaactacgccatctccaccgtctacaccaccagcgtccgcaccgtcaccggctgccctcctaccgtgaccagctgccccgtcggcaaggtcaccaccgtgaccgccccggcctacaccaccatctaccccgtcacctccgcccagcagggctccgactccaccgtcgtcaccgtcaccaacaagcctgccacctccgccggcaaccagcctgctgggtcctccactgccgcgggtagtgctaagaccactgtccctgtcatccccgtcagcatggtaagttatcaaaacccgagagtggatatgtgtagtgttttgtactaatatctcgtagggaaatactgctgccgtgtccagcttcttggctgccgctggtgttgctgtggccttcctccacctcttctaagcttcgtgctcttcagagcttctgctaggggctagtatttatggtgctcttggtaagagtaggttaaggttgttattagtatatcaagatacctaatataatggttaatgggaaaagtacatcttcatcagagtgcaaaacgatgtgaggatggcccctggatgagacacgacggacaaggaaggtattgtggcttgtgtggttccaagaggataataaatggttttataaagttcaaagcctacaaagcctagatattgattacgagtcgtattactagatgccccttccgaagcgcaggcaagaatgataatgtgttaactctactcccaagagtcggtggtcgtcttccccttcccctctacaacaccgtagaccacgtcttcacatccacccgggctgtcttctcccacctcatctccttctccagcccccacagcttcttatttaatcatccagcccatcacggatctggagatagttgaggtacctggtcttggtccaggacctgaagcgcttcccccaccacatcatgggaagtgagaggccgagaatgacaaagctcagcacaccaagagcgatgaaacactcttggataccggtatccagccagtagctagcaacaaaggtgaaaatcatggcgagcgtgttgttaatgaccgcgacccccaccataccctcgagaaccatgtccggatagcagtccgccaggtacgtgatgctcaagtctcccgcgcacccgtagccaaagccaatgaagcccagaccgacgtacggcaccggccagctccatcccttggcggagccgatgccgaagagccacatgccagtcgggaagatagccatgcagagcatcatgaggtgtagtcggaactcggcctccatgatgcccctgttgcgacggctcctccagagcatgaacttgtcgctgcagtatccaccgtagaaacagccaatgacgctaccgatgatgcaagcaaggttcatgttggctacggcggcgtcgtcgtagaaccacggctcgtcggtccaggtatcctcctccacggtgagatagaaggacagggcaatgttctgcataccccattgcagaccggcgtaccagacggcggggaaggtgaagacacgcagggtatgccagagccggtgcaggtattgcatgaaaccagtcccgcgcaggttgcgggctggtgtaatcagcctgatgcgctgccagtacgtcttgcgctcggtgtatccaacagacaggccatcgctatcacgctccacgtccgtcgcgctgacgcccacagggggcttctcgctaacagcagtcttttcaccctcgatgttcgtaccaacaggagaaacggcaccgtcgacgggggcaacctgcttcgtctcggtcgtcttctcgttcggttcgtcgttggtctcgggagcggtcaaaccgatcgtgttgttgctagcgcgttgctcctcaaccctcaggtatcgattgcgatcgaatgcagtctcctccaagcagaaataagtcagaacaagggtaccggccgatattatggcaccaaagtatccaatccagcgccagccgaccgattcatcgtgggcaatgtaaccggcgatcagggggcccaggtacgtgcccacggacgtagccagagtataaaagccaagcgaggtaccgttctggtgctcgaaccaaatgtcgagtagggacagctggacgacagactcagcaacggactcggaggcgccgacaaagagctgcgaccagatggtatcattggtgctgctcaggtatccaaaccagaggttcccaccgaagccgagcagcgcgctcagaatgtatccgattcgacgaccgtagagatggacgagcggggagctcagcagggtccagtagccaatggcgaggaacaggacgcccgcaccggtattgaagtagtcgtagctgatcccatactcctcttcgacgccggtggaggcgacaccggcgatgttggaggtggcggcggtcagggcgacgatgtagcagacgatgacggagtggaggacctttcgagggcggctccatctcaagggatcgttgggggaattggtcgggcgcgggacgaggatgacgtcgccatccttttcgatgagggactcatcggaggtacttgcgttttcatccgtgaatattcgttttgtgcctgggagcacatcatcgtagagattggaggttgtcgggtgaccgtccatcaatttcgacgcgaggccaagtcgcgaccaacgatgctgcgtgctgattcgttggttggtggcggggagctgtcaagtagaatgacgcgtgtctagcggtgtttagcgggctgcggcgcggcgcgaactgttgttggcgggcggctcagcgggtggcaggcgagctacagggagtgggtgcctgtggagagcgctggttggcggtggctgtaggggaatgggtcactgtcgcgtgcgctgatgaggggtacggctccttagagccgcatgcgttccgcgagcaagcagtgagggagagaggaccgactcgacgggggagaagggagaagacgatgggggattcgattagcgatgtcagcaaaccatgattttccgttgtggtaggaagcaggaagaggaagtaagaaggcgaagggagcaagggagaaaaggcacgatggcgatcagtaaattaagaacagaaatggaacaggaatggaaacggcaggtcagtggggaaaagctcgaggcgaaaatttttctattgatctggcagctgtctcggtcgtcatgccacggccttgaattgcccccagcctggatggagtcgatgttcccttccaattaaaagcttatcgttccacatcctgccacggctggtcgttcgccactttgcctcttcagagctgagagcgcccaaaaaccacgcagtcgggccgtagtatccaagtccgatcatcgaccagcccggggaggcctttggaagagacgcgatgtgactgggaggccgtatgggggtccggggttctcatccgcgcgctgtctgtagagtaaagagcaggcatctgctggtacaatacttctggcctggcatcaggctgtaagccaagaaccctgacagcctgataagagctcccaatttcgctctccccgtcagcttggcccgtgttccacacaactgataatgcatatctctaaaagaccagtttagtgtgacacaaaacggaactcggctcggcacgttacatcattgagtgggtttggattcatcctctgtccgtatcttaacccattacgtagtaggctatattacagactcatctgtacctgcaaacttttggcccagttcgacatatcaatgaagcaatatgttgccaaacctgtgccgtaaatttggtgacttgaggacgatcgtgtatttgttcgagatgccagccataggccactgagaagaacggcatgtcatttgggagaactgcctgatcacaagatgatttttcatcccagttcagccttctagcagcaacctaacggttggtaccaagcaagatcacaccactcgccagatcgatcaacataaacgtaagctaagtaattgtgccgtattccccggcttaatgctgtaattaaaattcgttgaattattctttgtatatgtggcttgggcttgagagtaatacaactggtggttggcgcacttgagaatctgggacggccagttggtcttgaaacctccggatgtgatttcattgcttcgccatgttgtcctcaattcacagctggactagaggaaaatgagaagggctagcggacagccagctgaatcatagccagattcaactggtcattccattttcacagggtaggcacgtaatgtgtgtataggctgcagggtaagtcccgtgaacgccgttgtaattggtacaatgatgcttaggccaacttctctgtgatagcttctataattcagtcaagtcgctctcaagaccccagcataagatgccggatcagggcctgacctttctgctgtctcatgcgaacctttgaaccggaagcgtcaactccaacaatcaccccatcaacgggtgggctgcaagttgatcccagacagtcaaacctaccttagataggtagcttcttctcattaactatacatgctatccggggtatgggcagttaaaagagaaagtgtctggagcattgggggagaccatgagaagctatgcaatcggggattgaaaaccatgtacttcgtcaagcgcatttttgacgcaataccatatattcaatggttctcaacccttcccaggcgattggacttattcctgcctttgtgtgtggttagacatgaaatcggccatctgtgatggccgtgccaatgtcgaaatgtttcatgatcgagcttgcttgggagtcctcgggttccaggccaaggttgcgttttgcgtcttctggtgactggcaggagccaggttgcctatagcaggcggctacagcctgttccaggtgtgattcagggcacagttggtgctggccgagcctgtagccactggtgccactggcgctgtaatccaccggaccacctgaacatcgtcctccagagcggcgcacctcaattgtcgggtgaatatcccattgcttttttccaccatgaagcgagtcctcgtttttccaattccttgccgaattctgcaacagactctgtctcgtagaatcctgtggctagtaaattgtctgccacggcctcatcagacggctggcctgctccctgtcgcttctttttggcaccctcatccgcaacaattatcccacaagacggagcaggtttggagacacagcggaaatccttgtaccgcagcgcgtggacggtggctaaccattcctccagaccggcggcgtcacgagattcggcgaacatgatgcctggacacccgccactgcggacgagtagccagtcgacattgagctggcttgccgcgcgacggacacgctgtagcttcttgcgtgaggtgatgtggtgagtacggataagacagttgaatatggtcggcacacgagacatgctgctccggtaccgaaagctgtgaaatcaggatgccattcatggaagaagttggtgatgagtttgaattcaagccgattgtctggtccctgctgactaaacatctccgtcttgcctaatttcacaccaccggagagaaaacaagcctgaagactacacgagatgtagcggctgaaaataatccggtggttgcttcgccgcgtctgccatcatgcggtttgggacatagcaatggccaaccacctggtaagcattatcgcccgcggcgccgtaccatggccgcagcacgatggggacaggcagcccggccagcacccagacctcgtctctccctgcctcggcactctgcggcgcgaggcccagatatccgctcgcgctgcggaaaagcacgcgtgcctccaggtgggagcccatcgcgagctcgaacttcttggccctgtcttggattctctgccgctcctgctgccgctcatcggcgtttgcgctgggcgcgactacggctgctggctggaacgtcctcagcgtctcccggatctgtgatggggaagggaagaagccgtcctggttcagctcccagagctgggtcattgccgatttagtcgcgtcaacgagggccacagcatctcgtgagctgattgtctccgtttgcggtccggagaacatcatcttgcgaaactcatctgatgtggtcaagttgggcatgggtaatccacttcccagtctcggggcgttggggtcgctcatattgtccttgagataatcattcatctcatccagctctctctttgcaagcagcacggcggctgtgggatcccatctcgacttctcttcaatgacccgcagcttgttgatcatccagtctgcgaattccgctttgagctgggcccttgcctccgagtctttattcatcttgagcacggaagaggagcagagaagtgcgctcagcaaccgatcgtcggctggatagttcacgtggggcccatccatttcatacagtgatttggtgagcgccagaacagatcgccagtcgccgttagctatgatgctattgaagctgaccgccgtcgcttggatcgtgtctgctctgtggccgtacaccgcaagcacagagttggccgcgacaatgttgataccacgttgagcaccaccgtctgctttccatctcttcttctgtgacgtgcctaatagatctagcggaagtagcgctgcggtgtagtccggcatccatgagggtagtgtgcgtttgttgcggaggctgcgatcttccacttgagtgaggatagttaagtcccctttggctttgataaactcgactgtaaactctttgatgacctgctcgatgctcttgttgtagtccggcttgaaattcgggaaccggatgccgagtctttgggcgcttgttttggcgaggtctagcatcgcgaagaacttgtccctgtggtctttggcctgcaatagtcgccctgccatgagcagcttgtacggagactcgggtgaaagggctctgaacgcaagattcttaatcgtgacgtgtaattcgattgcactggacaagggctcagcactgagtttactggactgcgactccaaatgctcccacatcggcttgaacgcatccacttctctccgcaagagggcccaggtgttgttggaggagaggtacttggtagctcgtcttatgtccttccacacaaacacctggcttccccagaccatggtgttctctctggcgaacgccaactcctggacgatccaagcccgttgaaagtatggcagactgagcaagactaccgcactcatccaagccaccgagctgaagcgtttcatctccaaggtcggatcataagaggcgctggtgtaaactggtttgggaatcgaagataacgccgtgatcacctcatgggcttgcttagtgtggctgtcttccgggcccagccaagagatgaccgccttggcggacttgtagatctggcccatgaaagcgacctgagaggacttctcgacatcatcttcctggttgatacacagctgatctacccacagcctgtcacatcctagcctgctggctgttgatttttcatcgccatcgagtgtgaacaaggcgcggagagcattgtgtagattctcagttatgggtatagactcgccgtcacagatgagttcatgctgctttccttgagacttgacctggcttttttgatagagggaaatgcgtgggtcgaaccatacgtaagataaggccatgtacgatggatcttggttaatatcaacagtgtgcaagcgagcgttgatgggctctgatatgtctgaccgaatcacctccagaagacgaatattggatcgtagcggaagtttcttgtagaaacccggtggaacagtcaagatgtgttcttttggccgcactggctggaccaaccctgtgtcagacggcgcactgacgtcctgcttttgctgcgatttgaggattgtctccgtcatctcccgaaacgtctcgttcaaatgctctagcatgacacgggtggcactgtccgacccgtcttctgttgttgatttcaacaacacctcgttcatctccactcggatctcttccaattctcgagcagtaagttccgcgtcccgtcttcgtatatgccagaagaacttgagcaccttggggctaaaagcaaacttggccatgcgggctatgtcccataggtttttgcccatgccagaaatcaactccttgttgcttagcgtatccatatcatgctgtgattgaacggttccggattgtagccctcgcgactcgtctgaggctacctgcggcattggatcaggtgcttccgggtggtcaacggcaggacggtgttgggaagcagcagcgacatcgcgcgagactgcaaagctgctgcgaagatactgagaaatgggcgccagaggtcctgctgcgccactgaggccggttgagaccttgaagagcccggtgactgggctgccccaggaatcctgcaggaggtcgaggtaggtctttgcaaactctgctgcgtcagggccgtcttttgagcaccactccttgacagaatcctgacgtaggagttcgcctagtcggagggccagagccgcgtccacggggccatcccgtgtcgcgtcgtagcctgatgtctctagcctctgcgacctctctttgaggcatcttgtaacctcatcctcttcctcttggctcattggcttcagccatgacagaattgaaaacatgttacttagtctaatatgctcatgtgctcaattgattggggtagagaatatgtatcgtgttcacttttgcggctgggttcaggcaggatggcgcaagatgtacgaaagtcagccccacgtgtaaggcattttcaagggcgtcctgtttgcctgtccactgaaggttactggctacatagtatgatctgagcatggaggctttgacagggattgagcgatcctgacttattgccatccctgccccgaacctgacctttttgaccgggcgagagcgtcccgactgagtcatgacggaaggactaaaatagccaatagtatgctatttggtcatttatctcctatggggcctgatatgtattagatgcaggaaactttcgtcttgttgggtgcgttggctctcaaacatactggtgttgatggatggagctacgtaggatgcataggggtcttaatgtgttgaccacttaatctttggatacatactgtttatcactgggtattaggaaaggcgaacactgagctctcttttggtccacctttgtaatcctgatagttcttgttcataacaatgggccccctatgagcagatagcttgcggttattcgaggaaggaaatactgggataaaagccaaaatgaaacttcaatgcaaagagcggtaaccagttcttggattctgactcaaatacaaagagactcccatctcgctcgctctttgatgaaagaaatagttccttaaaatcaaaaacgtccccaagcctgattctacctcaagagaactttaagaagagcacacgacctgagcggcagccaagagctattgttgatcttgccacagctgatgaagatgcgcgatactccgtaggcagccagatcaattcctcctgtcgacctttcacaacccattcaccattggagcttattccataacccacacggttggcttgttgagtaacagcagtgactgactcattatctagcggtaggtggaagacccggcagatccaaacttatacatccaatatccgtagagaggagagagtttgtcatagggtcgaacgagactcgggcaatcaaagagtgggtcctgagggtctgcacacacgctccagtcgccgcatgccagaccttgactgtattattatagatgcattccgtatcatacgtgcaggaggcgagatactggttatccgctgagaaggctgctgaggctaacttggaattgtgaccctcgagaacctgcatgcattcgccagttgatatctcccaaaccctagccgtcatgtcgtatgaacacgagatgagccgatggccatctggcgagaaggctactgagcttaccagatcagtatggccctcgagcgtgcgcatacattcgcccgtcttcacgtcccagaccctagctgtaaaatcaaaggatccggaggcaagccgctggccatctgttgagatacatatatgaagaactgaagctgtatggccttccagtgtttgaaaacacgctcctgttgttgcatcccatattttgatcgtcttctctcttgaagatgaggcgagcaatcgactgtttgatgagatgtccacacagaacactgaatcatggtgaccttcaaatgtccttacacatccacctgttgtcacatcccagatcctcgccctgctgtcattcgaacccgcggcaagccaccggaagtctgacgagaacactacaggatgcacccaaaagccatacccgtcgggaatatgcgcggatgagcctgttcctgtatcccagattttaagtgtagcatcacgagagcaggagacgagcctctggctatccaccaggaagttaacggaggtcacagcatcaccatggccactaagagtctcaatacatgttgaagttggtatatcccagaccttgaccataccatctcctgaacctgatgcgagtcgctgattatccgccgagaacgccactgagcttacccatcgggtgtggccttccagtgtttgtaggcatgtgcctgttgatgtatcccacactttaatgatgttatccatggagcccgaggcgagcctccggttatctagaacaaccaccgatgacactgcatcgctatgcccttcaagcgtttgcacacataccccggtccttatatcccagatcttgatagttcgatcgagagagctcgagacgagctgctggctacccaggaaagtcactgcggtcactgatccttcatgaccgacaagtgttcgcaggcattcacatgtcgctatgtcccagatcttgattttctggtcggaagagccggaagcgaggcgttggacgtccgagatggccaccgacgatactgaagcgccatgtcctttaagcgtttgcacgcatagccctgttgctatatccaagatcttgattgtttagtcgctagcgccagaggcgagcctctggctgtctatgaaggcgactgagtttacccgctgcctattgtgatcgagatcctcaaaggtctgtatgcatgctcccgttgctatgttccaaaccttgacttccccaaaatcggaggcagaggcaagttgctgcccatctggcgagacggcgatgcaactgacccatgtgttatgcccctcaagcgtttggaggcacgagtcccagtctgatccagggtttgggactagtctgacccagttcggctgttcctttttgaaaaaacccctgactaggctttcggtaggactgaacatgagagctgacacataggcctgtaatggagccatctctataactcgcttattggagagaatgaagcggcgagcatcccggatggttaactttaatttattcgacccagagttttcctgaaatcatgttatctcatttgcaaatgaatcgagaagtggggggaatctcactatgaaacgccaaagtttctccattgccaaaaccccttctgacatgctacgtaaaagactgagagcctccaaccaataaaggtacttagttctgaagaattcatgaactacaccctcatcattcagggcttcatttgccatctttgtgtcgcattccgattcatcaagatggtcaacccagtatagacaagaataccgaaccctagacaatggatcgggatcgggtgttgatatatcgtcgatgtcaactcccggagcctttaacccatagacatctcgttggagaatttctgatagacgttccagcgagttcaaaaggatagcacgatgctgatgcgcggtgcccgaaggtagaatatagccaaaggccttgttgagcaggtaatccttcgcagactgatgcaaaaagtagacgacgtcctcgcgaattgtcaagaaagaaccacacgcggcaatgatttatttaatctcatcctcgtccatatctgcaagtgactgtgccagagcttttaattcatccaacttgacgggtcgatatactaccgaagcaatggccaagacctctctgcaaaggtcagcatcttctgaatcacacacatgctctaccatttgactgtagagcgaatcaagcccccgggggaatgactgcagcttgctgagggaatgtcgtttcctggtcttagggtctgcgagctcttgacagaccaaggctacccagaggaaagtgccgtcagcatttgaattcaaatgacgttcaacagcttgttttgtttcttggtcgtaattcttgtcgcgtgccaattgttccaccttatatccaatatacgtctcgacagccttggaagttgaggttttgttcagctcgagactcagtccgactttctgctctgcattatccagcttttcctcaatatcttgccaattgcgactagaaactatccacttgacacgactaggccgtacaattaaatcaagaagctggtgtcggcttgtcttgcactcatcaagtgcatctatgatcaagatcgcaccctctaagcttggatcattcagcatagcggtaaatatcttggacaatgattcccatgcattcagatcctcgaaaagttgcttccccgcgtggtcgtatttctggcggatatacaacacaagcgatggctgttgttgaacaaggaggtagactagaccacgaagcacggctgtcgcattgcttaatcggtgttcagtagcctggcaaaagaaataggacaggagattggcagactccttctccaattcatcaataatcccacatagaagcatcgtcttaccctttccagggtcgcccttgatccagagtagttggccttgcgaatcgtcacgccatttcttggagtcatcatgttgtaggatccagcggtaagagtccctcagtagcccacctttggtgttttgaatacgtgtcttatcatcacgagggtcagtttcgcgcagatctttgaggcattgttcatttttatcatctcgatgtctcttctcttgttggcgcgtttggtcctggattgctgaatggatgccttgcagatttgtctcaatagcctttgcagagtcgacgagttttcgaagtcgcaccttgctctcttcagtattgtattgttccatgtctctttgaacagcatgctcggcttcatgtatcccgctgagatgaccagcccagtcatcgactttaaggagatctcttccaatggtagcagcccagttccggtgataaaggcagacactcttcatctgataggccagaagattcttatagagctgagcgatatggttctccagttgggctcgcaagcctgtgacagactgctcagccttgttctcgtcgagaagcagtgacaccaagttccagtaccactccattctcgacaatatataggcaatgcctttacgattatcacgcgcctcggtgataggattcgaaagaatctgtcaacaattagcagatgataaaggattggtcttccatcactaaagaaagttcgtaacactcacctctaatccaaggcagacgccggcccaggctatagcagcttccggagcagcatggatagccttatccactacttccctcactgcttccactgcctgtaagccttcgtcaatgcctcgcttcaaagacgcagccttttccgtccggtttagtccttgctgcaccagttgttgcatttggcgacacctggcctctcgggttctctctatcctattttccatcggttgattggtgacaggggctgggtcgcttcggtatagctcagttgatataatgttctcgtatgcttcggccagtttcggctcgcttgatgcaagctcatcataagcctcgttccaaagccgctcctgtagagtcggtagggaacagatagtggagtctgtcgcaggagatggacaggcggttggccgagatatcgcttgaatagccgtagaagagccagactggggcggagacggcgccgatgatgctgatgatggttggggagcctgcaccggctttttggcgctgaatccgactttcccaaaccagcgaggcgccatggtcagttataggataacatagcagctgagatggtatccgtaggcttgttcttcccagagcagtggctaatgagtcagggggacgaacaaattatcactattgacgaggcagtgccttgttttttcttgcatgtgcggggagacagctggcctgtggctgtgtgcatctcgcaaggcgaatgatgttaccttggctaggcaccaagcagctggacgcctcgccttatgcgaggacgctgcacgtcaccaaatcgggatgaaagcaatagaaagtgtccttgctgacgtcctattgccacacctcagaccactatcctctagctttcctagtactgcaaatcctattaggcgatgaattatatgtatagcagcacgaagagagcgttgtagaacgttccgttcctgatgatatctttccattgtttgatttcgtttggactctcgtccacttacaacccgcgcagacgggcaaccagccaacaagaattctagcactgatgcgatacggtccaagtttcgttcatcggcgtacttactattgcgactgtatgtgaccatgaagaggggctgattgcgtatcacgatggtcatattatagaatggctcacattggtcatgatgagttggtggcctggaaaatcagcgcgtcgggaacagcggaagttttcgtaactgatgttctagcggtttacttgcaggaacacattttgcagttttaaaagggcttttttcctggttcaagagaaaatccatgagtcttatccaactggccaattgctccccttcaagtcgttggatgagcctagacttattgtcatttcataccgctctctacatcaactacctttccacaccctaccctatcaagggcagccattaatagctaccaaaatatatattacttccctagtgctagtattctttagctcctacaattcaattgagctttgaacgcggaaatgtccatcttcgctgtcaaacatgagacgtccaaactcattgactttggaggagaatcatctcgattctccacgaagggccgaagccgaagtagaggtcattaaaattttacctccacgcactgaggtactaactggaacggatgccactgagcaagtagtctcctcgcgccttggcaaccacggagtgcttcactttgcaacctacggaagcctcttaacgtaaatacccatgccgtccgcaattcaactcgcagagggcggtaaagtcacgtctgaggactatatgtggtaaaatttgcgcgctggattcattgtcctcggagctttggggaactaagtggtagtgaccggcaatgacgcgattggttttgtctactcccttctggctgccggcgccaagagtgtgttggttaatgtgtggagtatgtacgatgggtgacggcctttcttataatcagattttatgagcatatgaaatgggatggtctcctgctggtgcgcttcagatatcgtgcgagctaagactaaaacttagttgctagaaagtaagaatccttgattaaaatggcctcgggagatgccgaaatacttatgctcaatacttattgatatgcgatgaaccatcgcaaaccttttcttcccatctaggtagtatatttcgcataaattcgtccggctaaggtgacatagcccaaactagagtcgagccaaagccaagctagatagatattcattaccaagagctgtcagccctaacccctgctagattccaagatatggcgcagaacttgctggttccctaaccctgccaagcggctaatctaaccatccttgcaactgttgaccacccgcgcgcgcgacggtaaactttgaaggatctgggcgtagattacatgatatatctgagacacctacgggcggcatccgtctccgaggctatgctagggagaccaacattaagaccccatgcgaaggcaggatcaggatcaagtcgcctttcattcagtgcaggctcagaatctggcttggacaacttagactaatgcagctagtgatcaatttcgcaaagggaaggagaaatggtaacaatctatcagtagtactgtgtggaagagccagataagaatccccttgattactttgacgagtaatagagaagatgttaacgtccaatacggaagcaatagaagacccctcattggtagttatagaacacggtgcaccgaaggtatcgcgaaggggaaaaatgcctactatattcaaagtaggatgcaaaggaaaccccacctagctattgaataactctttgtacattaaaaagaagctatagcggcagaaaaggaatgtggtagtcatttcacaggtcatcaagaagcccaacccatgtcttcgtttagttagaaattggtatcggccttatagctactatgcacattttatcggcccgagtgccggatttaatgctgaatatgcgtcttccctgtgtcatggcgcaagtctgggggcatggaatgcaaagaagacttgtgtcttgctctaggttgtccagttatggtgaaaaaccgcgcctgaggatgtaagcggctgactatatttgaaacaacacccggcgactcccaccaaggcgccgaaatttagctccgtttaaagaaggctggtggagttccttttggatttggatgcttatctcttaccccttgagacagagtatatagagctagcttgcgccggctgttacgcacactcgtttgcaggaaagaaggcaaggagccaactcagcatctcgttcctcttcaaaacattctgttaaacaagcaactcgtctgtccagaatgagtccgcaattgttgaggactgtggccgctctggtcatctgtctttgcccggccgtgcgaggtgacaggctattcaccgtcaattgtgacccattgacaattcaacgaggtgatcccattgtctctccaggccagatttcctcgcatgttcatgctgtaacgggaggaaccaactttgccctgacagagacgaatgagcaggctgtcgcggcagcggccaccacttgcgacaagattctcgataatagcaattactggcagcctcagctctaccacgagcgctccgatggcaagtttgaaattgttaagtttgaagggaatgtaagtgaatggtcttcccactgcccaaccacccaagactggtattaataaactgcctttgtcgatttaggtcgcatactatatcgaacgtgcttgtgactatgctccaggacggaccaactgcaatactgccccgaagcctatagctcctcctcagggccttcgcatggttaccggcaacccgtttctccggtatttaactcagtcccatatacgagaacaaaattctgattgtttggcagaacgtacaatagttccgacattacgcagcgtgctatccagactttctgtttgagtggtcccaatgagggtgaacgcccgactctccctcgcttaccttgcggccggatccgcgccgaaaccttcttcccttcatgttgggatggcaggaatctcgactccgacaaccacaagagccatgtaaattgttatcattaatggatgtaccctggccaggatcgacgggctaatactgtgacctttagatggccttcccagcgataggtgactacaacggcggagtctgccctgagtcgcacccaaaagccatcttgtctgtcttcttcgaattcttctacgacacgggcgctatccagaaccccaatcgtcttgtatatgcccatggagatgctagcggttacgggctgcatggtgattatctccaaggctggacagaccaggataggctcgagacagcgcttgatacttgcgaagatggcgtggatagtaccggctgcagtctcaacgtcggcagtgatgggcatgctggtcaccctagttcacaggtacccgctactcccgcgcctgatgaagatgtcggattgaatggtccattgtccaaacttcctggggataatccagttactggagaaattccttaaggcactctgaatattatcgagactttttgagggggtgctgtttcagcaccaggtagtcaaagatgagactcgatgtcgctctggatatttactctaccggaaccaaaaagggtagtattgatcaacatttaaaaccaggtataccaatggcagcttagtttaaattcgatattctttcaaaattctatgagatagaattttccagatgactcagaagggtagtctttgtctctgcaccttctagttcgttgaggttcatagagcagtgatccaaataatccgaatgtaccatggcaagtttctaaccagcaaactgcggaaaaatcaaccgcttcattatccatgcaagtgatcggcatacttgccccagtcgagagcgtgatacaccagtacgagtgctcagtcttgccgtagggaatgcatctcagccccagatagcatgtggaagatactgcggaatatactcttctctgtataccttatattgccggaagtattacctccacggaagctaaagtcgatgtggacttccaggtttgccactcatctcttggtccctaaagttgaatgtaaagccaataggctatagaactacaacaggaccggtcatgtaggggcctaaatcgaattgaacaccagatacgtctatggatacatctagcaagagaaaaagtgcaaggggtctgtcgagatattacccgtgtaagttctggaccgacgagcaacatggccgtggctggttcaaacctcttaaccggggcaaagattcacttcacggcttgatgactcagatacccaacagctgcattcattcggtgcaagccctaccatccagttggtaacggacccgatcaccacacttgctacctcagagcccctactcaagcttgtattaggcaataatgaagcgagcgctaagcttcttgtgacaaatttgcacactcatagacctgaaatggaatatgatttgggtaatcacgcctgatacattcatagcttctccccgcgttgctgatttagatgcctatttaggcagtgtcttgggacgtagccaatatctggtcatatgccaactcccattacctcctcaaaaaggacatttatctcgctcggatacgtgcgactgtaagcattgcaaggcctcttaacccaaggcagcatcattattgtcgatctgagagaatcaggaaacggtcttttgacactgctacacggagttgttctttctactcttggcgctccttttctcaacacttagtggtggagaaactataatcgcatcctagaagcagtcctttgccaagaatcaataatttggtatacgatgttaataaataagctcgcacttctagttcttgaacatcacggaagcagtggggtcactttccgtcgcccattttggctcgttgcttaattttgtccgtttctcctcccacatcccgttagcgtgaaacaagatggcgacaggtgacattccgagcatcatgccgagcgaaaacgattggaaggattgagcttgaaaccctcgtgttacaaaataaagttgcacgtcaaaggtctgaccccctgaaagtcgggtgaattatggtttgccgcccgctgagagttgcagcggatattcctttattgcttcattcgttttgttccgtggcatgttagttgagacagcgttaggatagcttcttgtctcaggttgcattgttggtgagagagctatgagtagatattcctccaatcagagctctactaccgatttctgcaatatagttagtataatcacaatattgaggagtatataaggaaagatcaatccaagacgagataatgaagtgtaacagcatcagtgaaccaagcagtcttaaatcaacacataccaatccagatcaaggatccacaacagcaaacaattcacgatgaagtacaatacccttgctattcttcttttttgcggcctggcttctgcccagactcttaacattcccacacgagttggggatgttgttgccctttctcagccttccgtcatcagcggttcggtcgatcttggaaaccgcgagtttgaccgtggtgttgcctgcaagagcggcgagaacggcgacaaggatgcagttttcattctcaagaacggcgccagcttgtccaacgtcattattggcgctcgtcagctcgagggtgttcactgcgagggtgcgtgcaccctgaaaaacgtgtggttccgtgatgtctgcgagggtaagtttcccacgaatttgctgagtggaatattttgtttcctaacttgctgacgctgtcagatgccatctcggccctcgggaccggcgatgtcctcattcagggtggtggagcccaaaacgccgatgataaggtcgtccagcacaatggccgtggaactgtcactatccgcgactatactgttgtcaatgtcggcaaactctaccgcagctgtggcgactgtaccaacaatggtggtcctcgtcacgttgttgtgtccaatgtccgcgccaacacgctcaagtctgacctcaccggcatcaactccaactacggcgacactgctaccatcagcaactcttgcggtgttactaagaaggtttgccaggaatacaagggtgttaagaagggagacggtgatagtgaaaaggtcagcactactgctaactgtctgggaggtcaaggaaagctttccaagctgcctacctgttaagtggagtcgcttgtgacacctgagttggactttgctcatggaatgggctgagactgttagaaaaacacaggaaatccaagttaaaatctggggttggagtagtattcgaacggtttctagtcaaactaaaaagcctgaaggagtgccaatatctcgcacgtaactagaaaccacaatataacttgaacttgtctacagattcagctcgtgatcgtgggtattttgccatcactatatcctccataaggaacgtccacaattgaaggcagaagataggggcggtccaattaacgtgttgggtctgcatatctcgagagccatttctctgcttccttatgttaatacagcgtccaacagcctagagactggagtccttgtcaaccttttcaatgactcttccggatgctttctgtccacggcctgatggtaggaactcgagtggcctaggagaagagtggtgcccagactatccagtagagggcaaaagatatatgaattctcctctttgagaacacaatttagcttctatctagatctcatagctaaccacggctcacctctgaagattctagagaacaaactgcattaatcttaacaagaagcgtcatataaacaaacagtctaatcaaattactcagctaccgtctactctaacgataaatctaagtcaaagttaatctaaaactaataacaaaaaacaaagtctcaatagcaaattcgatctcccccgaaaaaaaccgaaaaactactcactgcaccatgacatatccaagtggtactttatgaccttgcacccctacctatcacacatcggtgcttggcaagggccacctggctttcatgtggcaataatgttgataccataatgaaactgcccgatgaccactgaaagcttcctaagctccaccacggggatcttggcaagtaccattctggcagtttccactcagacactgatcatcaaatccacagtccgaaccgtttatggccgatccacgtttagggttttggcaaatactgtcctgacaatttccgctcagacactgatcatcgaatccgcagtcagagccattaacagccgacccaccactcggcttaggctttgggtcctggcatgtaccgttctggcagcttaaactaaggcattggtcattgaaactgcaatcagaaccgttgatggctgttccgttgttgagagcctggcagataccgcccttgcagttcccgctcagacattggtcgttgaagctgcagtcggagccattgatagccgatcccgtggtctgctttggcttggggttgtggcagatgccatcttggcagtttccattgcggcattgactatcaaacccgcaatcggagccattgacagccccatggggagggtcctggcagataccattctggcagttgttgctcttgcgctggaaatcaaatccacagtcagaaccgttgatggcctgccgagtaacatgagatgccgcgttgctaacgccagccaaggcgatggtcagggcgatgatgctgaagtattgcatgactaaagttgggattcgaaataagcagtgttgttatttgttgttattttgatgctggcttttcggatcgaagcaggagccaaatattgcttgtgttaagtgatgactaggaaaaagaggaatggcggctatcgaaaatttggaggaaatcaaactgaaaagaatactgattgtatgattgaaagacagatgaggtgctgagaagatggtactgaatgttccgtacatgcagctggaagaagtgaagctttatagtcttttcttgtctatgccaatttcatttcttagccgatgggtcttgctaaaaattgtttccatcaacataatccgtctcttattagataccagctgaccaaaacttacccgcatttgatcttgcttaccggcagactcaccttccggctccgcccccatggtagtgaatgtttcgcagctaagccacctcgcgcgggagagacttgccataggtatttggtgctattttcaagctgactgtggcgtagatatgcatgactacgcttaagatttcgggttaaaacggctctttcgtgatcaaccaaagtgcttcatgacagaaagttagtttttggaccccattcttgcacgccatgtcaaatgctaaattgctacgtagcataaaagcatgactctaatgaaggcctccccgatcctaataatggaactggctgtcctcacggcacactcgggcagtaagctacttcgcttacaccatcacacgtgaatatagtaatccagttataacgacacctgaataccagatattcagcacggaagttaactttccgaccaagaggacttgtgtcacaacttaatcttttaaaaataaaccttcatgttccaatccaggaactctgaatctcaccgccataagcattacatcacctccgagcagtctggtgctcgtaatgcttaggcagctaagactgcgaccagtcttggttttgctactgaggttttgtttcacagcctccaccctggtcatcaaatctatggagcacttactttgcaaatatctaacggggcccgtcatcgtacacttgctttaagaagatatgcgtcaagtagaagtgttttgttatcactttccacctaactttttgccagactatgagaccaaggcgaaatccatcgccttggagtatactgaactccaaaaactaacttgaactcttgttctaatacgttcaagtgcgtatatctagaagagtgcctccatccccctctccccccttacccatgtcatcctacacgccatacagcatccaacatcattttccagcacccccaccaaagtttttcaaacggcggagaatattcttagccgagcgtctgatgaagccagccaaagatcacacgattcatttcttgaaaggccccagattgagtgtggtacccggcttcgccagagaagagatggaaagtagccttgtcgcccagtgcgtccttcactcgctgtggttcgcccttgaagaacccttcaaattcggcatcagcaatccaaacgggcataccaatacggtcagttatgccgtccatggtatattgctctgtcttcttaagaaagtcgtatggagatttggtcttgaatgcccaaagtccgtgctccataccccaacgaatactggttggggcagtggaattaagagcaagcagtgatagtgcggcttggtcaaaatcctcctttttacctgcttcatagatctccaaaaggtcgtcaggaagctgtgctttgtatgagtcatgaacagagaatacaccgccattcaaagccacagcttttagccgcggctcgaatgctgcagctcgggctgctaggtagccgcccatggaatttccgtaaagggccagtcgttcagtatcaacctcgtcagacttttcattcaaaacatagtcgacagcaggtgtgacaacgcgctcccagtcggggatgaaaccgagatcctgcttctccgaacggtgggctgtcctggtccctcgtatgttaaggcgttccatccgagggcccgtgcatgcacgaccatgatatggtacatatcctcctgtgcggcgtcatacccattaccaataatcaatgttggccttttcttcttaaccttgtctgcggaataccagatagcctcaacggtgaagttgtcggcggggatctgaacgcgctccccaggtatgggtaatgctgccagaccttcgttgaaggcggcgagctgctcgtcccaatattgttcaataatcgggttgtcccatttgcccttagtgaaggcgtccgcacgacgaaagtagttcgccacagaaaaccaggtgtctctcacattgatagggtcgaacgcgagagtagggtccagagcctgggccttcgtcttattagcaagattgaataagacctcggagaatgtttcaaagtctccaactttgatatcttttgcagctgcgaggaggggagctatgtcactccctccaccaatagcctgcccgaggccgccgagaatttcgaggtgaaaggtagggtcttcactaagaagtagtattggctcctcctccgcactcgcagcctcggcgagatatagattcgacaccgcgtggagaagcgaaatgttgagaatcgtggaagctttcatgttcgaagttaagagataatcaaaagggagaataaatagatgatgagttgttctggcctatgacagacaagactacaaattatatgggaaagctgttttcttatatattcattttcaaagctgagtctatacacttgaaatttgacgcatttcttttactcggtacagttgctgttgcatgacggctgaaccatgtccaagaatacagccgaccgggggcctagaactaagccgaactgggggctattttagcgacgaggttgtcgatccctccttgaagcatcttaccattgtccagaactccggggcatattaccatcgggcttcgctgccgccgctgctaagtccgtacgtttccatagaatctggaagtcgatgatagagttaaatcctctcatacgattcgtatcgcaaaaacaaccccgtttcaagtatgtacaactgttttcaactactcgtattattttctctgacccaagtctagttctttaccgcccccaggttcctacgtcgggaacatacacacattccgaactccgatacgatactaagttatgcttaagctagaagttccaaccccgaccggcctttgcttggtaactgaacgggtacagtatcctctggcaggcccctgttggaggcgggttcgggatgtttgcttctattttcaaagccggggactcgggattcgagctttggtcgggttacttcgccaacttgttcatgtacacgctgaagcagactttatgtagagctccgatcttttggaactctggcaggtgccctgaactctaaaatcttagtgtaggcaatcaaatagcccattataccaaacagtgtatttcaatctgtttgataccgtattcatagtgcagttttgaaactatgcgccggaaatctctcagttactgatattgactaatgtagctcaaagtcccatcactgagggctcatttcctttgcggtttacactatccgtgacattcggttattgaagagcagctcctgggattaggggacccgtcgcttcagcaactacctttactgtacatactgaagaagtagattctcttgttagtgatacatagaaatctcaaaggtttgaactaaacgtgttctctttgcctcatgtatagggtagtgtgacccccacgcaactgctgctttgtcagcattctggggtgagagttaccctgagacagaaattcgattaaccggaaagacgggtcagtcttttccgatgccgaagagtctcagatgttggttgtttcgttgcttcgttgaatcgcttgctgagtgcctgaagttcaggagaaggccatagggcttattatgggcttactttgctgaagcgcagccaatcccttattaaaaactactcgcttggttcgtagatgaatgccacgaaagttgaaggttacgcgttcggaaatccgtcgtgttccggcttttcacccgaaatggaaagtgggccaaaactcagcccattcttgagtctcatataaacaaacgccgggataatttgatgaagaagcgtgcctaatacctacaatggagctcccaatttcgagggacggcatgggtattttctatcagatgacactcgacagtaagaatactcgaaagcaaaagcgagcaccgtgaactggagttccagaaaccttgaagtccaagttaggtaaatgccaagctttttggaaactggggtactggacaaccggagctctgaggttggggctgtattttgggcgaaattttgtgcatcacgtggagagcttgtcgtagaagagctcctcctgcaatcttccagaggagctattaaacataagtacgtccagaggcttagttctgtagtaacaggaggttttcccgaccggctattaggttgatcagccgagtagtggaatgggtcctgcatagactgaccggggttctcggctcaacatctccctcggcgacggcgcattgatcggtcgtccgtgtcgaatcgtcaccgggagaagggaatccagtagacatgatgaaaagaccggcagctttcacatgtctcaggcggactatatcctcggtgacggcggcggccacctccaagatcgacattcgccggctccgggacgcaaagcccgcggaccaggcggtgctcctccgtcgagcactcgcatcaccaacagccaataatacctcaatcacaagccagctccttgattcagtggcgacaggaagcctgccagatctacctgtgcgaacatggctgtccatcgccgaagaccctcgggttactgtcgccgttgtttgtcagcaacatagtgtaactcttcgacggctggctatgcccgttctcacggcccagcttcgcggtgatgccacttttaaacccacgtgggatgctctcggtggatctgagggcattgtcaagctactttctcagtttagcatgactgacctacggttgtttatcagaagtctccgtgggacagcttttgccgggggccagacacggacggagcgtcaacaacgaatggcagagttgtttatgatgctcaacgatggcaatcggaatccagataagcgtccattggatgtggaatatgcgaaccttctgccaagctgcccacctgaaatggctctggcatggacagatcaaaacagtgtacacgagtctgtgccacttcgatggagagagttgctcgcggataaccaaatggtcagaaaatctgttctgaagcgagttatcagagctcaccggacagcaataattgagatagacctccgaaagtctttctcagcgtcggagaacaaagtgagttgggaaaaagtccgacgatctctgacccatagtcaaggcttgaggcttaaagtattccaactactggccgcaaacaatgacttccacaggacacatattggcgatattagggataaggtgattttaccacttgcaagacaatatagtcgtcgacgctgtgatccgaaggctgcatctgaattttggtccttattaatcgaggccttaaaggattgtccggccttgtttgattacaacgcaatcgaaaaccaagggatatgtatccatgattcagttcctagacatcggaggtctctgttcgaatatgttgttcgtgcttggggtcacaatttattgcctgacgcaaagcttgcaacctatcttgaagcatttcccaagagagaatcaaagcacatttcagttgaagttatcttgaagcaagtgccgagggacaagcggtatgcgctcctgcgtttattcttcaaacacaaccgagggtatcagctggaaattggaccaccttccagccgctcaggttatatgctcagggaactcaagataagtatagaggtcttccttcttctgcccaggcccgaagctataaatctgtttgagcgccttcaagacgcacatccaggatacggctactctgccctcgagccttggcattatgaacaatctgagctagggaacctgtttcagctcagtacaaacaatgaagacgagtcattgaatccggacggcccagctctgcggggctttctcttgcgcaatatctcacatagtcctattcactgccctgtcgatcctcgccacgtgagaaatcatttgcgagtgactgagctctctcgtcgaaaatcgttatcccagcaagggcgcaccgcagaggtcagggcattctgggcaattgctgcctgccgactttgtattgccatggaggatattgatgcttatgtcaatacattgatatgggcgcgtcgcttcaataaggacgccatggtactaaaatctttatacaattaccaggaactccacataccgcccttgttacgtcttctgtctgcgatggatgctgggcatacaacagcagatattcgggagaatattcaaaaggcaaacaaagtactgatgacacttcttgaaacagcggccatgacggttgatttgccctctttctgtcggtctgattgggaatcggtgtatcagctcatccccaaggtcgttgaacttcgcttgaaaaactatcaaaacatgcaatttaagatgaaatggtccgatgggcaagtcttcaatgtgattctacaaccaaccttggatatgatggttgcagcagagtcgttgatcctccggcccgggaatcggcgccttgggtttcaaagtccgaatggatttccattgttcactaagtcgtcatcgacgatggagtttactcctttagtcgtaaaattcttggatacgttggcagataatcgggacagtctttgggctggatttcgggcgagacttgatgctgaagcttcgacacttcaagtgccttggccaaagggactcccagttcagtgtctgtggccagaacatcacatcattcaggctggcgacgcttcgtacttgcagaaacgagctcaggacgtcgtgttttgtgatccacaggcggctttgtctccagcgccgagctctgccaaggctcacgcgagcatcggcgttttcgtcgacgattggagcgtggcgctccgaatctaccttcatggtaaaaatggcgattctaattacgaaacgcggcttaaaacggcttgggattacgcactctatcatctcaccggtgatagaatgtcgacagaagaggcacaaagattctgggctcaggtgtttccctacgccgcttcaatagccaaggttcttgatgaggatgctcctcgtcgttgttacactaatatccccaaacatgaatccgatgaactatcaagaacaacagaatgggaccctgatccaacttataacgccataactgtatatcgaaaagatgagagacgcctccgacccgcgacagttctcgactgcatggtcaaacccggttggaaaatgggcactcactggacaaagcggagactgacttggatggaaccgattattccgaagcattcaaaaactgtgcttgacttctggcatccgaagtctttgtcagattgtccagggtctgagctagacaatcagatgatggcggctgttttgtgtcttgacagtacacacggaacgaattgttctctatctaagcagacagtttcggaaaagaatcaaccgttcgactctaaactatgcttatccaaaggcttttacgagagagaaagcttgatgttcgataaaatagtctcatctctaagactgaaccgcgcccgtcttcctcctcaacttctggcggggctgggaatatctatcctgcggcgaatacgggaagatccagtcaaaattgagggagcatacgggctcttttacatgattgttcggatgctgtcggatgggccacaaccctcactcgccagccccctcatcaaggagttcatcgtagaagtcccccgagctagtgactggcatcaatatctattgagctctcatcacttaaaccagcttgagccccaagatgcggaggctttcatcgagtcgctctctggtggtatagtagagaagctaagattacagaaagcaagagaagcatcagaaaccggccacacagtctcggaatctcttctccgagtgtcaactgtcaagtctgtggagcaacttctgcgaggcaacagcttcactaccccacaaaaggctgtgaatatactcgccgagatactgagacatagctcccatatcgaaatacaagtggctgcgataaaagctctcatcggattactcatagatgacggcggaaacgtggaggtttttcagctactggaacagtatgctatgcccatcgcctctgcgctcaacgaaaggcacaccgacatagagtcggaatggaaaacagctagcagtggaggagaactcccgcttgttgaccatagtcaggatggccatactgtgttgggcatgctcatgccgaggaaacacaagccttgtagtgatgcgctactaaagcttgcaacccaggccctccgcatatctagccaaaccaattcacggtggctagtacttttcatggagaagtatgggtttggaaatggagcttcgatactgcctcgaattccaacctgtcccgaaaagtttctagagttgctgcgacagaaagctcctcacaccatatcagtggaagatttcaccatgattcgcgactatgtgctgtttctgcttgaccaaccaaaggacattcgagagttcactacttatgtacagaacaaccgaaaattggcaagttccaacactggcagacactggcttcatttgtggtctaaaacctctaaggaggcattggatttgggtggaggatgggcagcagagatgctggcctcttggggcaccaccagccaaaatgatggcaaaacttcaaacatctcgtcgatggcggaagactttgtgttgcgtatggctgagatagcaatatcacgcggagatttggccctttttgatgatattgtatcccggataccagcaaatgatcccggcggagttcaggggagtgctggttctggcagggtaatcaagcaactgattacgaggattgatgaactcagaacacccgagtggcaagctgaccaccatcggcgaccattcgcgttgccaaatacgttgcatctgaggttgagacttttagatctctcacatggcgattccggggccgtttccgcattcgcggagatgattgtgcagttactacgtgaaatcacaacaggcggcagactgtactatgacgagttcgagatcatacggacgcatattatggcaacagttcctaagcaatcagcgcaatcgttggctattgctctaggaagtcttgataaattagatagccgggccactccaaccccagcagatcatctccgaaccaagcttgcagcagagcttcttgactctgataagtttaacaaagaaaacaatagcaatggtgaagcaaaagaaaaaactgggctggaaatttgggaaatgctgaataaatggagcatgagcccgattgaagagtttagaaacttggcatggcagatgaatgcccaagttcgctagtctttaatcattgtatactacgaaaaatgggatgataatgtcctgggaggataggaaaaaaccaaaatgacagcctagcaaggcccatatccttatgtaggcagtcggttttcatgtgctatatcggcacaactgccttagtatatcatgggatcatcacgacccaaacacattaggatgcgttacttcggttggagatgatgaaattctccatataccctcaaaaaaagttgtatcatcatataaatgtagccattaagctatacacctcgtttaggcgggttcaatcttgataagaaaagtcagcggagaagtgatagctgcacccttgtcttcttcaattgcttccttaatctcggattcgaaaaatgtcttgagcctctgcaaatgagttttcttcgagtggtcaatctcgacctccgctttcctgtcatccggcccgttcaaaatgcagcgaatgtccgatggtgtggcatcgtcaaaaccgtgcagcagctcatccttgagctgcgccaatgtcatatctgaaaatcttgctttcgattcccacgatttagtcaccttaggcttatgcgatttgatggcatagtaccatatctcgggttctgggggtatccgcgaatcggcgaaactagcattctccaggagagctaaaccagtttcctgtcgcctttctgacataattaaggacgagcaatgtggtgcgtcgtctatgtttatcattgtagcttgaggcgcgcgaggatgggtgcctggtgataggaagccttgggacactgtcgaggaaggggaggcagagagtctggatctgcttatgttttcaacagtcctgttgagtggcgatcttagttgattgaccggtaattcggaagccaaggctgagttcgattcgtgagtttgagaaggtagcctgtcctcgacctggcctttgtctttgccaggcctttccgcgccaatgaaaagctcagtcgaagaagatttcgttgggaaactctcttcggctagagcgcggacttcagcttcttgctggggactaagcattcggggctccggaaactcatataaatccaaaacagaacgatcggcctcatccaatttgcctggctctcgtgcgggttccgttagattgtcgtcccgggcgtcagttgtgtccaagttcctggacgaagtaggcgtcctcggcgttgtggtgtggttgcttttgcgcttttggcccgtctggtggtcgctcctctgcttatgcatgttcttcgcgaagaacatcttgcacattagctctttgattctgtattcaacgttaacaatgagttggacgaatggggtaggaggcgagcttaacttacatcttttcgtcccgtggccagatgaggctctcgttgtataatggagagcattcgtcctcaggccaaagtgttgatccttcttgacggagaaatcgatcagtcatttccaacacaaattgttggacgtttggtttcttgaagtcgccccacgccttgaccgctgggcactttttggcatagggagcagtgaaaaaatccacgtattctttcagttttgagcttccatcactaccggacctctttttcccatagtttaattgctcgcttagctcctgaatggtcggcatggcttatgttttgcctggagagatatgagtgggaggtacttagtgtcggattcgacgggcgttcggcatatcaagagtcaaaggaaacccagcgatcctgttgcagttggctaagcctggtctattataaaagctgaatggcggtgacatttgatggattctaacccctgaaatacggccccatttcaatatgagccggctgcggccaattggtgcaagctgagcggttacaaccaacagatttcgttcggcggctatgaaaacactgaaaggaacacacggcttgaccagctcgaggcgcagcagcttgcggcgcagtgcaccattgcgaccaccagacaggccgtcgttcctatgacataatgcgatggcatgcctttattattagtagccaggattcattgagcccaagtggcgtagcccaacactttaacaatatggattctgcctagctctgcgtaaaactttcgctgagggtttgaaaacctagaggtgtgcatgagttttgagctatgcggagctttatattgtttcccaaaaggcatttataattgattaaacggttctcaatattgcaaatcagattattcaaactactaaggttagacgagatgttagaggaggtaaacctctagcgcccagactcatccacaggttctgggatggtcgaaggatacaaacttcacgcgaccagttggattcaattatgctttgttttcaaatgacgtagtttaatagttgaatgaacttcttttgagccgcatctacgtgtgccgatgatcttttcccacgattcatgattcattctcctgatttctccctttagactagtttcttaatccaatcacgtagattgttcaaggacaggatatcattctccttttcagaagtagagaataccttcgtgttctcatacaaacctggagaaccgtgtgcatccaaattctccccaaaaggttgacaggacccaaagccaaccagaattggcttgttcccttgaatcatgatgttgctgtgattgatatcattatgggcgaggcctaatgcgtgtaaatgatttacagctgattcaatgtcatcaacaaacttgtttttgtctctttggttgaaccccagggtgtttacgtattggttcaaggttaattcgaggcgctccaaccagattgccgtaatccgaccccgtttcactcgacagccaaggtattggacgaggctaggatgaggggatttagatagttgctccattatcaatgtttcttttagaaatgactgggggatgaggctgttatcgttcttaaaagagtaagactttagctgagggcgcttcaggaaagctaactcctccgtcaggttattaggtgcaagagtgaggttggcgtctgcaggagcttcaggccagaccgtctcatcgggaacgcgcttgagagctgaattgtattcggggatcgatgtgtccattttgcccttcgacgtcaccccgaaatacaattcgtcgctattgctgatatgataaaacgtggttgctttgagtttagtcgccccgcgctcataattttcaagaattgtgagatcttgaacagaccgaacgagctgtggccccttgtttgcagactgagcaaacatggttccaatttctctgcaatgcggcgggaagatcgagaatgacatgatgaagatgtttggtacttccaggtgtggactcctggtagatttggtccatctgctggccgtacatgaggggtaaaatatgttttctagatgatgcccgggctctgacagtctgaccgaggccgatgccaaggttcaaaaagttgctgagcgaccaatcactcagctatcacgtaaacattacatgggtactttgattgtatttcaaatccggagatgaccattcagagatgaccatttactccaatggccaatagaaacacatccttaacgcaaggcccctagacttctttgtccaaatcctacacaagacatccatcacggcctttctctttaggccggacgttggattattaaactcgtgttaccatagatgtggtctcgatttctcagcaagtgttcctcatcaccaatcatattctggcccttcctgtggatagaggttcatttactgtgaggggttggaatagattattagtgttcattcgcaacgtcggccggatctcaagatagtcacctaaaaaagtccaagccagcctcggatcccgcccctcaaacataaaaacagcatagcttccgtggtatctctgagagaagaccggtgaagggctgagacggagactgagctgtcttctgaattcgacattgccgatattcaattattaaaaagagctctagttcccttctacttatgcttttttgttagggaataggcatatatctcgtcttgcctgcgttgggttgtattaatattacgagggttgcgttcacacccgagagttttctagcagccctataagcttgtattctctcgcagaactcaaaacgatcttcaactgagtgtcatatgcctgataatttgagttttgttcatgtatttgcaaaatttgaattaagataggttaagaaattagaaggaaattgtgacaaaattatgttgcagcatcggttgtaaactgtgagcgcaacacaccccgaaagtcccccatattaaaagagccagcttatatcctcatcatcataatcaatgtaatgtatcatattattttatccaataccggttgtaagcatttcattagcatatgcgacgtctcaagatccaaggttcgccgggctcgtcgatcgtcagcggacattccgattgctaagttccgtcggaagcttcctgtctcgaggtaattgaatcggatctcgacttcgctccagaagtgttggcttctcttatcgaccgagccccgtctatcgagaatccaatgtgccatttttgttgataccctaatctcgcggcgaagttcatggatgcgtttctcctccagggcaagatcttccggtatccagcgtggcggggatatgcaggttagggcttcgctcagccgtatggcaaggtgatctagagcggatcgtggctcttgcgacggaataattcgatgtttgaaagttcccctgcttggttgcccgtctagactgtcctgagatttgccatctccctgatagctggaaatggtgacaagcgcagcagctctatcaatcggcacactccccgatgatatatcgatgtctgctagggcaattgctattggcttcatccgagtttcacgagacctcttgctgtccggtttacatgctctcaccaacagatctccagggtctttcccacatttctgcagcacgagttccagaagatcatgaccagaaaaacaccacacccaactacagtgttgctgaaaaaagggatcccgaaggagtgacgagatagtcatcgcactgagagcacggattgctttgacgattgttgtgtctacaacctccacggaaacatggccttttctcatcaaccatggaagggagcaaaggctgcgcgcactaatcgacgcatctgaggaatcaagagccagaatgtgttcaacaatctgtgactttcctttgaaggcagccagccacagcggggatgcagatacgagatccgaggacgattgtagttcggcgggtttatactctgccaatgcattgacgacagatgggtcatgatatgcgaagtttagcagagctcgcatttcttgaaagcatccttcgccattctcctcgacccgaggacgtgatattgctaggaaatggacgacggagaaattgcggtattcagagttatgtgctttgcagacggactttgttgcagtcgcactgaatagacaggcgccttgaatgaggtgattttttatgcactcgaagcagattggttcctcggtgacatagttgtcttcaaggtagcgaacacctaacatagccgccttctcaggatcatcggctgctagctcaatcatggcctgctgacattcaaagaagcctctggcggtaatggacgaattctgcggcggtgttgtttcctcttggattctcatgacatggttgccggccaatttcatccataaccccgcccaatgactctcttctttatcttttgtcgctttgcagatgtcataaacaagttttatagccgccaatgtgtgcctatcatcgtcaccaagggttttctggagcattgtgacggactccaaggcgtgacttttggctgatgtccaaaagtttatcttagagtatgcctccgcgagtgacttgtgaacaaatggaacttgcttctggtcggcgttcgggtgcgtgatcgcatgctctaggattttaatggcatctttaaatcttctctgtcccatgtatgcttttgccagccgtagtcgcgggttgagatcaatgtggctcttctgtccttcttctgttgccgcaagctgaacgagcggatctagtttttcttgttcaagaattttgatggcatcttcaaacatttgcttcttcaacaaccaatcaatcttctttgacagctcgatagccacagttgcttttagctccccgtccctcgaagtatatttctgagattctgtgctaaacccagggctattcactatcactacagcagcagtcaaacggaccacctgtagatgagatggatcagagagtgaatccatgttgtcgagcatcagtcgaaccagaggaacagcttggtcatcctcacccttcctcaccagatcttggatgacctcgaggctgcttgccatcatttctatctttaaatcttgagattcggaacagaatttgctaataactccaattaacgaaggtgtcatgacactgaattcgatgctgtcgcgaatgagtgtgagctggtcctgatgtgatagcgtagtgggttgacgcaaaaggaagagcaggtctgacgaggaatctactggttgattctcgttcaacgaccgagtcgaaacacccactcggttctttctcagattggacccgagggtggagtttgtccgtcgaatgtctgctgttgtctttgttctttctgtcgttggagaagtagctgtagcagaagccggttctttaactaagggaacctgcgctgtcaggggcgataggaagcttggattctgagttgtgggaccccaacttgcagatggtgcgtcagtatcggttgcaaatgtttggctagctcgaagccaatcattttgaagatctgcccccagcctgtttagaaagacatgtagtctgtcagaaaatgtaaggtttcggccatcatgctgagaaactcacagggataaatcattcgatccatcgttgagcacgtcatctgatacctctccgatcttggccaaccattcatggaggcttgcttgatatgcgcccattctcttttcaggctcgacttgtaacaagtcgaaaatgaagttctggctgattttgctggcgccattctgttttaatggcgattctagtttgagagcgcgagcttcttggctcgaggacaaatattgagaaagggttgttagatctttgaatggcacttgccctgtgaatagcttcatgctcaatattcccattgaccacatatcggcagggaaacctggtttcgaattttcatcattcatagcaacgtcgttgctactaaggccgatctgctcaggcgctgcatagcccatcgtaccaacaccgactgtattaagagactcctggaggaatctttgtttgctgataccaaagtctgctatctttacggaccagtaaggtccatttgagatcaccataatgttctttgcgtaatacattagtcaacagctatttgtaaatacaaaaaaaatacttacgcttggttttaggtctctatgtatgaaccctttctcatgcatatagacaataccctccacgacctgcgagatgatctggcggacctcgtcttcaggaagcggcgagtagaggtggcggctgagatcaccccactggtggtattccatggcgataaatatcgaggagtcgttctcgaaccaaccatgtgattggacgaagcaatgcgagtactaggcttattaggatacgatcttggaaatgtgtcgtcagagctcttacttggggccgggaaaattggactatagcctctagctctcgcgaatagtctatcaccctctgttgttgatcgtgcttcttgatctccttgacggctctcaacctggaacttgactgttgacatctctcgagcctgacggtgccaaagctaccactgcctagaatgggtcgtttggcatccaaattccaattttcgactctgcgcatcggcactgactggccgccggcgccattacggtagatgtgctgtgtgctgccatcaagaaagctggtatctagtctggcttcggctaccagatccgacagctttcttgctaggtcttcggcacgttcggttgacatgctgagggatcgaaattacgagttttctgctgcagataccgctggtaggaggcaggcagaagaccccacaagccagcctgggggcggttagattaatctcgaagtgtcaatgatgagactatcggcaagagagcatatcgcgagcgagtagcagatcaaaacacctgtcagctgacagagagtaattgggtagctttcaaacgagggcgtggcaagtgtcgaatgcaacatgggacacgaccagggtttcttcgtgtgcgttacagagtctgcacagcacagacagtgctttaacagggccacgtcgatccttaattttgagcccgtatacgtaagattgttaatactacctgatccctcagactgaatcactctgggcttggatctttggagacaatcatcacagcgattctcgcaatctatcacatcaactgcgcttccgactggggcgatttcaggcatgcagaactgtgccgtccgtcatgcgggtaataccggcgggatacggaaatggtcaagagctacgatagaacgagatatgtcgcatagagcggagataatctggaaacattcatggcttggggttgttcttgtcgaggagaaatcttggagatcacgtacgcgacgaacaaaaagcagaaattgaccaaagcaaagaaggaagaagacttgtctcatttctcattggactgattcacgcaaggtctgtgctgcacagtccgttgacggattctctaggggcagtgacagggaccagggtacgaagagttccgaaagcgatgatcaagacctagtttgccaccgcctctacaattgccccggcagctccttgattcaagttatccaggatttccatgtcttcgtcgtcgagggagaagtcgaacacgtcggcgttggctttaatccttccagcgttatcgctcttcggcagaggaatccagcccttttgcaggcagtagcgaataagcacctggctggaggccacgtggtgcttctcagcaatacgcacaagtgtactgtcttgtgctttctggttgcgcaccaaaggagagtatgcctctactgcgatgccatggctacgacagtagtcgacaatttctcgttgctgggaccacggatgcaactacggcacattggcgttagctatgtgatggtggtagaatgaatgagctgatggaagccgcgtacctcgatttggttcacgtgaggtggccagaccttggcaaactttcgcagctcctcgatatgcttgatgccaaaattgctgaccccaatgctctttgccttcccttcctcgtggagcctctccagagccgtccacatctcctttcgattctgctctccgccgcaattagggctgtgaatcaagaacaaatccacgtatccatgctcagggtccagtttgcgcacgctatccacgcactgttcgtagctgagatcctccgacccacctggataaaggatcttggtcgtcaaaaagacgtcttggcgacgcagaccagacttctttacagctaaaccgacctcggcctcgttttcgtagtactgcgctgtgtcgatatgtcggtagccattctccagtgcggtcaagcatgactgcgtgcagatactcgcaggcgaaagatagaccccgaacccaagctgcggaagtttattcgagttagagagcgtgatggagctgttgattgacagaggctgcattttcgacaggcagtgttttcggtgcacgagcaatatggcaatgtaggtattgaaaaattgattacagaataaacaatggattcagaatgaggggttggagtgttctgataggactacttaaagttcagattgcataatgacgtggatgatttcgccatgtgtgacgaaacgctgcatttaccggaacgggacagagatgcagcattttcttatctcttcgtagactgcatctattccccgtctcagtttggtttgtgaaggaatattgaatataccgcaggccattatccattcgctatttctcacatcttcatggctgctaacaataacgcccttctgcccatttactcaaggcgcgacttgaaacaccgtgatgccatacggactggtaccatacaactccactccgggtcgctaaagctgatgatacatcacaaattatttattgccagcttgattggagctgtagggaataatgttcccacacggaatagaaagagagctcaagtgtgatggggagccatcccacgagcaacgttggccggtagcatttcgagatatctcaaacatgatcgagatatatgcttgcagagcttttaaaacgacttggaactcaaccacgatttttggcatatgagccaaaaactaacaaatgagtggcgcctcttagcagcggctaggagtgagccatcatgagtgaagatatgtacccaaccaaggaacgcttacttcccaatcactgtcctcataaagaagcagagtgctaattccatacggcacatatgtttcagatataagtacatggtcagcttggcatgctcttgtcagcacagatgagctgcacactacgcccacagaccatacttcacaacaatccaccacattgagcacccaccacgaaacacatcatcatcaacgagacatcttattatcaactgcagcacaaaaaactgagccacattaggccattgaaccgtgccgctggtgcctagctgacgtaatcatggttctctgcctaagtcccccattcagcctgggcgaaccatcacgactattacctgtcaatatctacaggtcatcctcataatccccctcctagtcccaatctttgttattggatacgaaataaatacatcatggcatggactgcgtctacaaatcccgagcaggagtactacgagtcggtccattctgtcgatgaaaaagcgttgctacttgccaatctcatcaaacaaagcgagcacttcatcgtattcaccggggctggtatctcgacgtctgcaggtaagtcataattctcctggaagctccggacacttcaagtgacagttgataccaggaattcccgactttcgcggccctgatggcacgtggacactccaggcgcaggggcgagatagaactggtccgacgaccgatacccttcaggcgatccctaccttgacacacatggcgctcgtcgagctacagaaccgcgggctgttacaacacgtaattagccagaattgcgatggtttgcaccgacggagtgggatcttgccggtacgtgcatcttataagcttccaggcgccatcatcagccagccaatgttgatgatctagtaggagaatatatcggaactgcacggaaatagcaatcgtgagtattgcaaagactgcggtaaagactacattcgaggtacgatggaatcgtattggcgatattatgcgaggaaggccaatccccccgtcatcggggaaagctgacgtgctttagattttcatgctacagccacctacgagacaagcatacatgaccatcggacaggtcgcaattgttctagatgtggcggagatctccacgatagcatcataaattttggagaagcactgcctgatgatgtcttggacctagcgttcgagcacggccagaaaacggatctgtgtattgtcctcggttcatcgctgaaggtctcacctgccaacgagattcctgaacagattggctgccgccaatattcacttcgttggccggctaccttggcaatttgcaatttgcagccaacaccgtacgatgatctttccacaatccgcatatttgcgaagactgatgacttgatggtcaaggtgatggaataccttgaaattcccatcccaccattcattcttcgcagacatgtgactgtcaagatagagactgaatctcacattactactctgatcaatgtcatgggggtagacaccgatggaacgccggcatcctttcttcgcacagtcaaactactcaattataattactgcatggttacggaaccgttcatagcgtccatcggtggccctttgcaagtggacactgtgttcaatattgagcttgaattcatgggtcactattgcgagccaaagcttatcataccacacaaattcgaatggccgggtgctagagagtgcacctatctgctggaatacgatcccagcacaaggaaatgggaagtaactccagatacgacgatgcaaagcctgcgtgtgtagttattcggaggcctgagcttgacaagatattttcggtcaggaaacaggagtcaacattatcagaagtggtaaagtgaaattcaaggtccgtgtttagcctgcctctacctactcgaatcttctccttcccgtccagataaggtcaagagttggctgtcaaacgcattgtttggcagggcaagataacctagaaattccgtacaatgcgcctctctatcttgactttctggtctaggtcctgccggattcgttcggcgtggacagccggagattgcactggaatggtgcgctcgccgcaggtagaaactctatccaatgatttagtcatttccgcatgagaacgctttcactcccgtcagtccagtgtcaactcgaggaacgagaatgcccttaaataacaatagacgagcttgaatgatggctagatccggcacaggtattgggactctagtccatttgtgcaaggaacagactctagcccacgccaggttcgggtattacctttggactaggaatgcagatcgctttttttactagcctttcctactctgcataatttggactcggccaagatcacgtaaggcatgtaggcagatatgcgagtcattgagtccggagtctataaaaacgccaccccctcctcatcaggcaaactaactagcttgtccttctacgatgacaaatacggctcaacggacagaaggtattccaaaatggcctttaacgggactgcaaaagacatccacctggaggacgaccatatgctctgtgtcaagcttcgaaacaacagtcaagactatgtggacgcatcattggatttgaacgatgtggttcaaaataccaacggtttcctcagcttggacttggcaagtgagttgacatagagaaagctggcaggtgactttagtgtcctgacttgcataaatagctgagggttttgcagactccaccaagaacatctcactcatggttgatgacgatgggcacgtcatgttgtgcgcagacgctcagaagaacgatggctcatatcgaagacagtcgattcgtattgacaagaaatttgagaacatcgacggtgtgctcatttacagtacgtgggcttctgttgttgttgtgttgactcattttgcataaaattaacctcattggaaatctagcgggcgagtaataccacagaggctgttgcttcatctcctgtagcttattgagagaacgtagcacgagaaaaattcaatatcaaacttatttgatatttagaaatttgattcacttagaagcaatataatatttgatgctggaatttttgtcatcagaaacattgaggtcagggacgaagcatcttacacttcaacctttacgagagagagtggaccatctctgatcgtaccggttagtttatctaaattcacattgatggtttagattcaactactacagcatgcagattaaaaccaagagctttcagccattcaataatacggtgttgtaaatggaccttcaggttcttaaaactcatgaaatagccactaggataggattcactccaaaggccgagcctcatacgtccatttccaggctcaatcacttcgatctcagttagttcctagctcgaactataaccgagacattggtctgaagtcttaatcactcgtacgatggagaaagcagacattgttcttccagcgtgtttatagaaaacggggagcccggaaaggttgggctctgcgggcacgtcatcttcccctatgggactatttgttggttgcaggtgagatgcgcatctgcaaccaacaggactggcttttggcgtcgtatgagtaagctgtcaattggaacctttgtggacagaatgtagcaatggcctgatgtgctgctacgtagacctgccaaggtcacatttatgtctccatgtttagatgttccgtgtttcttcctttgaagagttgacaaccacaccactacatcccaatccctttgatatttaaggaacaacaagcctcaaactcagtcgcagttatgattgactacacccaagttagggcttttgtgaacaaccatctcaatgagctgagtggcgttctacgatctcaggtcaacgcccttcttcatgcgaatccagagcttggctaccaagaacattttgcgcatgacaccatcacggcgtttcttgaaggcattcagcctaagcttgacatttcaaagaagacttatggactagacaccagttttgaagccaggtttggttctggcggtcgtctagtgatattttgtgccgagtacgattctcttccaggtatcggccacgcgtgcggccacaacctcattgcaacctcatcagttgcagcattccttgctacagcccatacacttgctcagcttcagatccccgggcgagtaagacttctaggtacacctgccgaggaaggtggcggcggtaaggccaagttgattgaagctggtgcatttgacccgccggaagatgttgcagctgcactcatggctcatcccgtcggtgctcatcagatcctagccaaagacgacgaagtaggtcttgcggcgccgattcttgttgcgaaccacaagtttcaggtcgagttccacggcaagacagcgcatgctgggggcgagccgtgggaaggtaggaatgcattagacgctgcagtgtcttcttacaacaatgtagcacttctgaagaagcagactcgccctaatgataatattcatggcattattgaggatggtggtgttgcgcctgccattatccctggctacactcgcatgagctgggctgtcagatcccccacatgtgaacggagtgaattgcttgccgctcgtgtcaagaaatgcatggaagccggtgcattggcaagtgggtgcattgtaaattatattgagtatgtcttgcctccatctcgtagccaatactggtcgcttattagcatctaatctctttcacagctcacccacttaccaagaccttcgagcaaataacactctatgccagacatatgtcgaagagatggcaggtttgggaaataatgtgttccttaagcagagaatggatttccctgcatcaacagacatgggcaatgtgtcataccatgttcccagcttccatggtacctttgttgcttcgactctgggcgttccaattcatagtcccaagtttaccgcggaagccgctacagatgaagcacatgccgccacgattgagtgtggcaagggaatggctatgcttgctcttcgggtactcactgatgatcaagtagcgacaggcgcgagggaggactttgagaagagctaggggaatcatgtgagagagttttaccttgcacaaattatcccgaaccgcctatttcaaccggctacttggggcaattatcgcataaaaccctgtatctgaattataagttgttgtttgtttcgccatcaatagccagggtatggctaatagagttaaacctccttagctgacatcccctcacgaaaagagccttcaaaattcatgatatcattccccccacatctctaagattgttacagccggtcttgactagtgtcgagatggtgtttcctggctcattatgattcatcgaccccaccttgacttccaagtgccgcctttaaaacgtgtataccttgcctctgttccaggcgcgttctgtccgtattccttgcaattccggtatgaaacgaatagcaaggtccatcaactctagtattcagaatgtctaagaacgcaaaccatgcaatcgtgtttggggctgctggcctgctcggctggtccgtccttaaccaattgacctcaaattacccccaacctgggacattctcaagagtaacggctgtcgtcaaccggccaatatccgaagaagacctgaacttatcttccaaaggtactcaagattctgcaaagccagaaatacagattgtttcaggaattgatctacgaaatggcacgggggaagctttggcacaccagcttcaaaccagtgtctccgacgctgagaccataacacatgtgttctactttggtataataaactcctagctatggtatgatgacactggctaatttgaaccaagtgttttctgcactcaatagcgacgccgttgaggagtgcaagatcaactgcgatatgatgcggagagttgtagccgcagtgaatattctatccccagctctcaaagcctttatttaccccggtggtacaagagtatgtgaccgttcagctccagaattactatttctccaatattaacaaaggctcaaggggtatggaatctacatccctggtggcacttttcaggcgccgctggatgaggcgatggcagaccaacttcctgatgattatgccaagactgtggcctacccgtggttcaggaacatcttaactgaagccagcaacggaagtggctggtcatggacagaggtgtgccccgatgctgttatcggattcagcccaaacggctccgggtggtctcttgccctccactgggcacaatacttgtctctgtactcgcataatgaaggcacaggtattgcaaacgaaggctctaaaatttcggtgccgtttcccggatgcgaagacgccctagatagcaagtttaccccagtttccagcaaaatccttgggcggatcgccatatttgcagcattaaaccccggcgtatgtggcggaaaggtcatcaacatggcggatgatgcgaatcctaccacttttcgtcagctttggcccatgattgcttcttggtttgggcttgaaggggttggcccttctacggagacgggtgcgctcaagccgggcgagtatgtcaagaagcatgaagccattttcacagagaagaatcgcccgaaagctttatctggcggggttggagcaggcagtaaacagttggacagcgtcggattttggctcacattcgaccgacaattgagtctagaccgactgcgagcttgtggtttccatgaacgccgcgatccaatcgaaggatggatagaggcatttgagcaattcagggaggcgggaatcattctgtgagaatcagtacttgagtatttgaagttgatcttatctcttccatattgcgcatcttttttaaggaaaacattgttccctttctattcgtgcagtctattcttcacaatctcacgatctcgtgtcctcctccatggcttttcaagatgccaacaacaaagcaggaaagttcccagcatatgtgcatgtataaaaacaacaaatatatgtttgttcgacctaaatggccataattatttgttctcaccgtgatccgctgccatacagatttcccttcctaaagagtgaccacaatcttctgcgctgagacacctttcttctgcagttcgaatgcctcttggatcgtctccaacccgtgcccgacgatcagtggctctggcgacggaacaaaagaccctgaatcaagagcttccggcaagaagtcaacgaaaatttgcttgttcagccccgctccagccattccgtccatgctcacatagttccacttgattccgttcaccatacttctggcaccgtaggtcgctgttttcgtcaggtacgacgcggccgacgacaccatccccatgcgagttggctcgctgtctggcattgggagagtggccatggccacaaatttgttggcgcctttgggggccttctccagcacacacatacatttattccctgagcctggtcctatggcaacagcgccggcaaccaccttgcctttgaggccctctgctatttcctctactactgcgctgctgttgtagtcccacactcttgaggctcccagtctgcgcactaggtcgtggttctttggggaagctgtcgtgaatacctcgtagccagcggcgacggccagctgaatagcgcagcaacctacgctagaggatccaccccatacaagaactgtctttcccgttgatgggcgtgccggtaccgtgggcaagtcaagcccgaggtaggagctgtcaaatagtgctgctgatgcggcagcaacaccgaggggtagagtggctccctggataaaggacatacctggggcacggatatgagacacccagttttcccgaagcactgtgtagtgttggaatgcgccctgcgacgggtcattctcgtctttttcgatgccgcggcatagtccaagtacgcggtcaccaactttgaaccgggtgacttcctcaccaacctcgacgacctcgcctgcagcatcgaacccaagggtagaagagtacttcaaccaaggaaatacgagatcacctcgggactgaatgagccaatcaatgggattgatggccactgcggcattgcgaatgacgatttggccttttgaaggcgtggggtaagggacctcggagacagccaaggagcgtgccaacttggaaggcagttgtgcagcgtgatttgaaggcatattgagtgtatggtaggggttgtgatatgcgtggagccttgaggaaatacgaaattcaagttgagagtatataactgtgagttgacgacttttgagactaatgatggaatatatcaaccttcagaagaacacatggacaatatttatatgtccagaaagtagttactgctcctgttttcgacctctaaccgccgcctcgcactcgctttcacgttgcatggtgtctctccgccggctcagactgtgccgtcagcctttcggttatccaatcatcgtccgacaattctcgcacccgcataagcatcagccccagacacacgcttaaccgcttttaagtatggctcagatccgagctagcccaatgcgactttcaagggcttctcgcaccggagatggaaccgaccggcggcttcattctcctctccgcacaaacgatgaattgatccttcgagatgcagatctgtagaacgcttgtcgcattcggatgcaaacccagcgcgcaagttctctgaactcagtccgcatcaaaaactgaaaggcaggagccatgaggtatgtgcaagtattctgggaaatggaggaaacagcaataccctacaaagatctgctgacaaggtggtaatgtagttgaatgtccttctccgagaggtcagatatcaaatatctataaagtgacactaatctctggatgtatttcgtttagttttctagattgtttctattgtaaaataaaattataaaggcttttttttcctcactaattcgtcattctttgatccacatctacatcctgctgacctagttcaggatgggtgaagctgatgttatgcgaggtgacgacctaatgtggctgaccaaatcaccttatataatctacggtgatgaaagttcctactagccggataagagaaatgaatctcgtgattctagacgtcccaccataaatagcatatgaaaccgtcaagaatcaatgatgcacaacgatcaattaggaactgggctcagtgattactatttccaaggtataaggcaccaattaatgtcgccatgagcctcacttgtatccgtcggagccctccaggcatctcctggcttgctccttatgtgaccatatccataagccccttacaataagttgcgtctttaattgaccccagaatatgcacgagatcttgccgtctggtaacatcgttcccatttttctttctttctttcttttttggatcttgtacactacagcggccaaggctggtctcggcagcaggtagcaaatgggcttttcgacgacggcatgttgcaagtgcaatagaataatcacatcacaaccattgagaagaaaactttttgaacttctacttgatctaaatgaaagggagacttacggatgattgaactctctagcttggatgagtgacggaggtattgccatctttgcctcctcttgcatgtccgaagcaggaggcattgagaagccgattttgccgatggaatgcaaacgaggcaggattcattcaaaacggactccttcaccccaccaagagcgctacgctgcggcggatatcacatctgattcgggacgaggattcaggatcaagggttttggcacgggtgggaacaagcgaggcagggtctgggtgggtgctctcgcatttcccagttcagctgccaactgctcatgcaccggcatgaatttcttccttcattccgcaagggcggctgccaagccacgctgttttccaatttcgccgattcccgttgccgctgtcttgcattggcttgccaagaggcttggagatcgggaccccctactcgggaagggcgagaggccgttgcttgactacgtgtcatggaaggacgatcgataataccatatgtacagccaatgcagcatgagtgaggagtgtaaaaggctctacattcgaaggtcaaaaggacgatgggggccgccccacgcatatatatggcctgacccaacaatgcagtgagagaatacattgtgagtctctcttttccagtccggaaatggtgggcagcttcgagtcatttacgatcgttgccgcggacttgggtggcttctgccgcgtagcctgccggcccctcccaacgtgatgccaagccatcagttttcctcattgacccagtgaagccaaggggtcgggcgaggggagtccatcgtttgcttggcggttgtcggcatccactcgtcggcgggatgagagtatttgctggtatccgagcttatgtgtcatgctggtggagtatatctaatcagattgattatcagggaacgttgtcaagccgattatgggttgatccgctcgtgctgctgcgggtctgggccgaagaaacgtctgaccttagtattctaggcaagggttggcaactttatgaagcttaacggaggtaatagattgggtaagtcggccctacgcaaagtaaatcccacccaatcagcgacgccctgcagtcggacggtggtagtcacaaggctcctttccgtccatggtgggtaaaatcgctctcggtgggggctggaaagcacgcgcgtttacttctcaaggaaaagatcaacaaggatatttgctcggatgagggcaggtcggccaagaccgcgtggccatggcaagggtatcccgaggccgtgaatgggagtgtccttatgttccggtgatattggcgggcataggaaaaccttctctctgtgttttgtgtcaagtagtaatacaaatatggctctctcatcatccttttttttctttcggttgagatgaagtttggagagagacacactggtctcgcgttactctggagattggagcttatccttttctaactatggcagacattactaagaccgccgccgtcgacaccacgaccgctgttgaccccgagaagaatgttattcaggaatcatcaccacagcgagtctctggctatgagtcggatgagaaatcgcaggatttccagggtggtgttcagggcgcccgtgctatgacaagtgtttggactaacaagacacttatctccatgttcgtcatgtaagtatcaactttaaggtggaattgtcatgcagatctaacactaatccgtgacaaggctgtatcttgtctcgttcattgacatcctcctccaatcagtccagtcatctttgaacccttacatcacctcctcctttggaaagcacggtcttctgaatgtcgtttctattctttccaccgttctcagtggcgccaccaagcttactctggctaaagtcgtcgatatttggggccgtattgagggcttcatcgttatgttgctcatcgtcaccattgggctgatcatgaaggctacctgccagaccatcgaagtctacgttggagcccacgttctttactggacaggccatatcggtctcatgtacattatcgacattatgatcgccgatatgaccaccctcaaaaaccgtatgattatcgcgggcatcaatggcaccccaacgatttgctcaacctttgcgggtcccaagattgccgagctgttctatacaaacgtcaacttcagatgggcattcggtgcttttgcgatcatgcaagttggaatctgtcttccagtcttcttcgtcatgctcttggagcaacgcaaggctgctaagcaaggtctcatcaagcccaaggagagttctggccggaacatcgtccagtccctctggtattattttatcgagctcgacggtaagcctacttctcgatgagtacttcacccaccaaacccaagatttgaatgtactaacatgtgctagtgatcgggatcatcttgattgttgccgccttttccctattcctcctgcctttcagcctggtctcctactccccatacggctggaagacgggctatatcatcgcaatgattatcatcggtattctttgcttcccggcgtttgctctctgggagtggaagtttgcacctgtaaagttcattccctggaagtatctcaagaaccctactattctaggttcttgccttctctacggtgctatgtttatctccaccttgtaagtatcagatgagcatcttgttataaagtgaacttgaaaagctacatgctaattcttgtgggaagttgctgggacgcctacttctattcctacctgcaggttgtgaacaggcttagcatcaccactgctggttacgtcctgaacgcctattccctcagttccgccgtctttgcccctttcatcggagcgtaagtggttcttgaaaagcctaccatcgacatgatttatctaaccaacaaaatagtgtcattagctacactggagacttcaagtggtctgccattgctggtgtccctctgatgcttcttggaacagctctccttatccccctccgaacccctgaaaccggtcctggcctaattaccatgacccagatcttcgtcggtgttggtgctcaactattcgcatcttgcggtcagctcgccgtccaggtccctgtcacacaccaggaaattgccgtcgtgctcgccatctggggcatgtttggctccttcggtgcagcgatcggcaacgccattgccggcgcactttggaacaacatccttcccgagcagctgctcctccgccttcccgaatccgtgaagaaccagtctgccaccatctacggcgacatggttctgcaaatgagcttcgaggatggcaccccggagagagaggctgttgtgggtgcttacggctacctccagcgaagaatggtgatcgccggtgcttgtttcatgcccctctgtctctttgctatctttgtttggaagaataccaacatcaggaagcttcagagcgagcaaggtatccagaccaagggcagagtcttctaaatgccgacaggccttaagccagaatatatcatcggtgcgattcaaagatttcactgtgcattatttaagccagcattgggtgatcagaatggaacttggcactgcctccctgttctgtctccggcatcatcattttggtatcccgaggacatttaggtcagggcataaaccattccttagattttaattctaataaataaataaatcaaccaaacttactttccgtggaagcctggttttcttgtccgtagttcctaggtcaacggacaggtgcggccgaaacatctttgtagtcctcaagcaaaatcgtcatattatggggttgatagctcagcccacagaagtaaccttggaagagaagcggtccccaagtggcggtatgtagagatattgctatagatgcgacaaatctgacgagctttcactaagacacattcggatgagcctgtcatgcgtggtgtgcgaactccgcttaacggttgttgggcagtggtctgagtacaagctcagatcatgtcttggccgagtcagttagcgagacataacatatgggtatgagctaattctgttagttccattgtctggagtctggggattggacttgatccatcccgtctggtgtctccattgtatgacgagctgacgaggccttatgctcttaaccggcgggacgtggagaataaccccgaattttgaaggaacgtgactaaaattgccccatcttgagacattatcaacctatagctgtgtgatcagatttgtgattaggtttctcaccgcatctatgttttgccatgcttattcgagaggcaaggtaacgcgtcgaccctaccgtaggagcctaatccaggcacatagattgaatagccttaatcctgttgtttagtcttcatctacgaaaacagaatttgtccgaaggataattctagaggaatgggcaccagacagtcaagagtgatacacatgtaacgtgggtgggcataatcgtctgagcgcaggatggttggtggtagatcagatttggaatatgagccagcagtctgtcaacactctacaaaatgtgattgttggtgcaattgacggagaagggtaggggcatgtgatggctcgtttgacgacgaaggcacttcggatgacgggtgacattgttgatggagtcgggcatgtttgccaatagttcgccaacactaatacagaactcacaagctagatgaaacaagcggccgatagaggaacacccctctttcaggtgaggtcgaaggctgcatcatcccccgtcgtcatggcccgccccggatggctcgtgatgtgccaagaggtgacagcgcgacaattattggcgacgtacatggatccggttatagttgatgtgcatgcccattcatttccggcggggataagtcagtggacgcccttgagcctcatcatggaacaagatgtctggggcttcacaacttaaatcatcgactgaactcatccgatgacagaggggcagcaatctcgggcagccctggccatgcccccccagccatgaaaatggttcgatgaaaacctgaaagcgttgacgacgaccctgtacccttcgccgcaggaggatccaatgaacgcttcacctgcacgaaaaatcgtgccaagcttacgtcgccctgtgggtcacgatcagattagatggccaagaccggggatgaaggaggcgcctcgagggacggactgacgtggcccagcccatgagctaatatcaaagccccatcccggtctctgtctaactgcaccgggtcttgaacacccgataagagtggtcatactaaagggcctcacccgtcccaggcgctgacccagcctactcctcctcatgggattcagcttgccgtcagtccatcattgacgtttgcggagccatgttcaatcttcgacagctggcggctctggccgtcatctgctatgcctcgcccagccatgcggcctcgtcgctcaagccaagcaaggacatcgccaaggatcgtgcgcctcagatcttcaactcggtgcacgactcgatgcgccagtggggctccagccttcaccacaacggagtgtcattcttcctggccacagtccctgagggcgtcctcctctatcacggcaacaatcgacccgagtcgcctactgagcccgactggctggcgtacgaaatcgagcacgccgagcagtttgccagatcgagagggcctcctccgggcaaggacaaatcgcacgccgagcgtcgcaatccattcttcaatctcaacccagtggacacagagactcagcaacacatcctcaatactggcgataaggagccccagataccagatgatgacgagaagaagaagggtggctggctgcatgtgtacaagaccaccagagcccttcccttcttatacattgacgggatgagcggtggtaagacggagatgggaaccctggattcacaagactatcttctacgcaacaagactcaggaggaggatgaacccggccagccacatcgtggtcccatgggagaagggactcgtgctcgggagctgtgtgagttgagcacctcgtggggcttacagggtgtcattcgcatggaggctggctttgaaatcatcaagtgtgatttcaaggacggactggaggagattcagacacttcagcgacctgtaagagactctgatgggtttggccacccgcctggatatggtcctggtggtcctgatggagaccgccctaatcgtcctgggaagggtcctgatgctcctggaaagggtcctgatgggccagacggcgagcgcccagatggacctggacactggcctggtcatgggccggatggtcctggacgtttccctgaccataacccaggcggtcctgatgggcctgatcatggtcctaatggccccgagaagcgccctggtggacctacacgtcggccgggtaagggaccgcgaccttggccagggcatcccccgcaccagcctgaagataggtttgattacccgccaccacctcgcggcccttggtcttggcctggtcctcctcctcctcccggtcctcctcgttcacgacgccgccaggatagccccgaacatctacccccacggccagaccattggcctggtttccgtccacgacaccccgaagatagtcccgagcaccctccaccaccacctgcacattggccttggcctggtcctcctcctcctcgccacccacgagatggaggtgaactcccatcaccagaaggtcctcagccacgccccagtcaccctcatggacgtcctgaagatgtgcctgaatatgaaggaagtccccaatcatggcacgggcctcctccacgtcaatctgaagacgagcctcaatacccaccaccacatggccctgggccacggacagaacaccctccacgacgtcccgaggatagacccgaacatctaccaccacctcctgggcattggccctggcctggtcctcctcggcgccctgaagatgggtctgagtacccgccaccaagaggttcgaaaccatggccaggacatccccctcgccacccagagggtgaacctggaaactcgcctggaaagcgccccggtcacggccccgggaacggtcgggggaagagcatctccagcttcgagtttcttcgtggaatctcaaacagatacgacggcattggctctactcgcacgattttggactattcgtccatggtatcggcctatttcttccctgtcaatttgacgaatcccgaccccaagcgtcctgatctaccgcgactgaccaacctctctgatgatgagctcaagcatattcggggaattgtcggggacgtcgtcaaggaacgattggacggaaaggcaccaataataaattggcaggatgttgcagatctcgtcgtcaagcggtatgcggagaggctccagtttatgacacagaaaggaacctcgtccaagcgcattgcggacgaagcaaacttcctgctggacactttcatcgactattccactgaagagaagagccaggataactctgccagcatctcccgctgcagcagcctgttcttgcaaccgatcaaaccaaagaccacggccgatgagcttatctactctgcttttgaagaggtcttgtcacagatttgcactacactattcaaagtccgtgatatttctctcgtggctcagcagaatgaagattatgcactcccaactgctgtcggcacactacagtccttgttgaactacctcgggtgggcaagcttcaagcgatgccctccttgcggggttgacgaggtctgcctcatccccatgtggccgtttggaacggtggatgcttatgagcacccgcggtgcgtcaagtcgacagatggccgtggcgacggcgagagctactggggagacagacctgggcctccgccacccaaatacgagtaatttctttcatattagaaccattagtataggcagtagataccgttcaagcgatcaatacataattctctttcgtcttttacccagtttctcccctggtcggcatactttttttcttaatgtgcatgctgaggagagctaaatttccattatcttggcttttaagtcctaaactcctctttcgccaactgactcaaatgcccggtatatctgacgtgtatcaacacttgttatcgtaaagggtatttccatctctcacgactccttcgaacctggtgattaatgggcattccaaaaggagagcaaacctttcagtatatggataaccacattttttttattctacaatttgcgcttattgcggcgccatcgagtctcttttgttcaaatggggaaacctgctttttcgaaaacacgtacacataagttctggtcatacttccaggttgagtcgtggcgctgtcatcgacaattgaagccatcgtgatggaccctaccctatatcccgaggcgagacaacgtgaacggttctcgcatcgaccgttagcaaacgatgaccgttttgacaataaacgctaatacatactcattgatttatttttttaagaccactaaaatcaaaatttacccatcttggtattagcggccgacgtcaggccagtgggaaatctgccatcgagctttacggcattagccacctgagatctcgtgttgtcatggatctggaggaggcttggcagctttctcgtaatgtgattctccgcaaagtggattgacggccggttgcctgacgccgtctctactaggctgggatctattggagagacctggagcagcggggcgactatcgagactgttccaaactcaaaggacaatgggaagcttcaagacaggcagctgatgagtgagctgagtagtggttcgcgcaggcaacagtagccaataatgcctgggaacggacggaccctactttagttggtggggaccaacctggaacatgcatatgccctgcatcggagtcacagtcgctgtgagtaagcatcccgtacagtgattgaagagtcaaaggctagacgtagacctgggtctgtctgttggcttgttggaacaggtgtttgttgccccatctattcatacgctattgggcttctcacgccagcagcaagtcgaggccgattctaccatgtcttggacccgagaatcgatccattctccgagacaaaccgcacgctacttaagctgttggacacacgcggtggggaacaacctgaccgggaagctcatccgcacgaagggcccttcattgcaccaatgagcagccgctgacgacctgcaccagtcaggggcagaccttccacagctctttgtgttccgtcaggtcagacctggaggatcgaggattgtgctgttgtctcgatggcggcggaccgagcgaaccatggacggggagcaaaggcagggcaccacacatgttggtcgctcctcttttcttcttccttgctctctctacacttctgcgagaaagaatgacccctccgtctcgccgatgcctgatgcttccgcctactaggcatgctgttgcgcattgtagcagcgcatggataccactctgactgcactgccgatcgtaaatgaacgtctagatcaaacgcaatggaccccctcagcgtcaccaactccattgcgggactgggaaaggcagcggcggaactcgagaaagtgattagagagcatgtcgaaggcgcaaccaaaaatgtcccagacgttttggtccagttgctccaaaatattcaggctactgggaatgtgctctcgcgcctcggcaggacagtcaagaagcttgatgttgtcaaaccatcccagttgcaaacccaccagattgtcgcagtactcaccgatggtgttattatcttctcggagctagaaacagcagcccaggatattgaatgtcccccgttggccgatgtcaagctgcctttgaaggcgcatccggattggcctcgcaaggagaaaaaaatggaactcttgcagaaaaggcttgccgcatttgagcaatctacgtccatgattcttgccatcctgcgatcgtaagtggctcattaacgctctgttcattcacacgagtgggcaatcattgacttgggttaatagagattcacattttgagggcgctcaacatcgtatccagctcacaaccaatgtggatagtctgatggacgagaatttcgatgtcatgcgccgtatcttggccgccgacaatagttttgatatcgagaacctaagagcaaaaaagggctacctctcttcgaggaaacccgatgacgagaattggccattgccagcctcacctatcactccctcaagcctcgattctgtcgcagacctcggtgcagttctacctaggctggaagaacagtcacgatctgggtttttgtctcccatctcaacgtcatcattcaacttcgaagcagaccttgcttactctggcccctaccgacgcgcaaaccgagagtccatggacttctccatccgcagctccttccgaaggccttggtcctcgttatctgactctagccaagggcaggcatcagcgatatccgtcattgcactcccactgttcgctgatgatattacaaaccctcagcactacaactttagctctcccccttcttatccacctcctccttacagtccatttgcgatagagggcgaaggctcgcgtgcaggttctgcgttaccaacagtcgttgagcaagtcgatgagccgcctgtcactcccgtaccatctgttacttcgcctactcgtgagcaaatacttgcttctggcttggagatactgcatcggatgtattgccatggcacatctatctttcataactgccttgccatcaaatcacagctataccagcttctcgggtttgccgaagctatatcatcatatgcctttgagttgagagccacaaacccaatggaagaactcgtctcaatttttcgcgaggggtggcctcttttctggctcttcaacaagcttgattcccgcttcaagttggtcacaccgaaaccgggaggcgttccgtacaccgtgccgctgttctttaagctatgcaaagagtttgcctttgacatctacgagttcttcacccttgacgatttgatgggagatgattatcttggttatcttagagtaagttagttgctctttacacgagtgatcgtgcgattttggtagcaaacggtcccagtctgacctcttatagtttctctcaggaattgagctagtattatctcaactcatgtctcgaggattggtccgccccgtcgtccgcagagagttcaacttacctgaaatcacggaaatgacaccgttgcaagcccaccttgagacattcgtcattcaacagagaaggtactttctcgacttgggagaagtgctggagatcaaggatgtgctgcaggaggccgaaccgctctcccataaactcctcacagcatttgaaaccttgaaaatcatcattcacttcgaggctcgcttcttacttgacattgaagcacagattaccaagccgcgcaagtcacaggagtggggtactccattcctgacgtgggctgagggcagtgatacatacgccgagttcatatctctggaggatgacaatgccagagagttgaggcagcgctcccataggctggacagttcagagcagcaaaacgagaggagcactgtgatgaagtgcgtacggcgtattatgacgctacatgatcaactccgcaagtaccaagatttcttccgtgtatgtaatattcattctcaccctgtcgactttattcaaaggctaattcatgattgtttttaggaatttgatctaatgtccactgatgagttccaatcttggcaggtggaaaacatcgcaaacgggaaagttgcggtcaagaatgtcttagagaaggcatatgaggcgacagaaaaggccgacatgcgtgatgccttggctgatctgaaatcccgcatggtggattggaggggctaccgcattgataatttcggtgaacttattgcccacgactcgctcagagggcgatctgacaacagagcgaaagacacaactaagaccgtatgtgatcaactgacatgatctttgctagattttcctagctgacacatcccttctttgcagtataaggtgtacctgttcgagaagattttcttatgtgtaagagaagtcgatggtcctgccggaaaacgtgtgctggcactgcgtggacggatttgggccagagacattaaaaagattgacagtagcacagatggtaagtgaatttcagaggagattgccaagagtaaatgaatcaggtcatatactaatcttcggctgttggcaggcccgcttgcctttaggatacactggagcggggatgagggaactgatattctgactcttcggtttcgatcacggggccagaaagagagctggtgttcgaagatcctgcgcgtccaggaaatgtcggcaaacatctgctgggccgaaatttcatcatgaatggcctttttgcaatgagagtaagatgaatgacaacaaaaggaaagagaacaactggaaaggcaattgccgatctatatctgaacgttgcaagaagttgcattgaaccttgaataaatgctatttctaaccctgtttgctatcaaccatatgatctatcacctcttgcctgccatggtgtaacttatggaaagtgaaccttacagctgagatggttgcatcatagcggcattattatcgcacagcccacttcaaatatctgatctcccaatagagtcaccggggctataaataacactcttggcctaagggggaagacgagagccgtcgagctaacaaaatatcgtccgtacactctccaggggtaactgacccactggcatttctgacatgtagatcatgccgatggagaatgatggacttagttcaactcagagaggtacaagaaagattagattggatagtaagtgggagttgctgtcgtctaaggtgcttgaaagctgaggtggccccagcttggtttgctggcgtcagaataacaactgagtatatcttattccaactttccaatacaggacacgatattaatagacaatatttaatgataataaaaataaaattattgagcagttgttaggtaatattatctatttactgttacacaataggaaacaataggaagcattataaatgtaacttactgctacaagaattgtattgaagtgactttgcagtattatgattctcactgtcttacgttaggggctaaggaacatcattattatcaacattaacttcatacccagaaatattattatagataagctaaaaaacttagtctatagaataaacagcttattactattccttcaaataagtccatatgattagcgcatgaacggactgcaaacgaattctgcagaggagtcgcatctggttatgctaattcaacagaaacaaacctgatgtgacaatcagagctcccattgtattcttcccactgtattctcttccattgtgttgagatgtcgggtctagcgtctttattgctgttttctcctttgttctcaaactctctcatccgcgataaacaaggcatctttcatgtgccaaatgctgtcggtccatttcgtcactgctcgagcaatgacacagttgcgcgggccagaagggtagtgaaccagggctcaaaggtatcattggtccagtcggcaagtgcagagatggcagcttgtagctggtaaatgccaaaaatgctgtcggtatcacctatccggacattgccatctaacatgcgctatgtctgagtgtcagatactgactgaagttgagataaatgcaagacgacttacaatttccgttcctgcatccagagcaaacatgagggtccatacactggcaactacctgaatgacgggaatcgtgattaccttatctgttcctcccccgagcgcaatgatactgcgcatacgctggtgccacgcagcgacccaaacaccaagctgaacgttagcagtgtccatgttgccagatgacgtcttggtctcgatgaagataggagccggccgggtgcggagaggctcatatatagtttggttgaccgtaggcatcgtgtacggctgcctgtctaagaaagtgccaatgagattttgaagctcctccttgggacgaaggaccacggcaaagtcgaccatgttatggactgacaatgtagccgcactcagccgagtgtttggcgttcccaaacccagtccagacacactacttgcgtcagatacactggcgttagggggtcgggatggagtctgatcaccagtccttgacaaaggacgaaacgcaggcaagatctgagctgaggaaatgggctcgacttcaagagaggcaaagcgagagattgcacgccgtagaaccggcgtgtgcacgaggcagttccaagcggcttcagatcgatggaggttggatgaggcaatagaatcgtcaacaatccctcggaggtgtgcatgattttcaaggagcgttgcctcgttttccacgccagcttgaccagggacttgtgtagttttccacatatactcgcgaatcctcgtatctcgaaaatctgaatgatctcgaagagccgctggcaggatcttctcttttccctctactgtagagagagcctcaaaaagcatttgagcatcgtccgggagaacacttcctaggtcgcgctcttaatcgcttcgtaggggatgaactgcgcgatcgcgtggtgtcagaggtcggagcttgctgaacccctgtgggagccgaaaatgctcggcttgcaagaactgcagtgaaagaggacgttgagcgtgttgaagtcaccccttgtgtggccggatcatcaaagatgactccatcactatcatgtcgaacgggctgaggtcgggggcgtgttggagtctcgtcgggatcgggatcggagtatttgcttgtgcgcggacgtttgggtgggctcgacattatatcagaaagacgacgccgatgcgcatctttaagtaaggaatcgtctgccgatgtgctgtcaacgggtggagattctacttcgtcaacccacgcctgaataacgagatgattcatatccagaggttggatcgtgatagggtgacattgcctgacgcagaggtgttgtgtttgtaaggttgaagggacgagcctgttttagtggcctcggttatattttggttggtggatggcttgttgctacagcgcccgttcggaaatttgtaggcccgaagccaccctccttacataatacgaatatattgaatgcacctcgttgtgtaggcagtaaaaactgcgaggtcacctcaacagaattattgtggcagtcaactccataataatgcttcctatttgtagtaggaagcaggcaattttgcttaatagttgctcaatagtttattactatgattgttattgttattataaaccagcgtctatcaatatcgtggcctatattagaaagttaggattaataaaacacctttgccgtccctattattctgactcccgcttgccaggcttctgtgagattattttttggaataagtagtgttcagctattaggcatctttcagttgtgtggagttggcttgcatcatctcatttaggcagacgtttaatgcctctacttaattaccggatcgtctattccatcagaagccctcaaccatactttacgagttaaccaagtgaggggaatatttgcgctttccaacagattggacaaatggctgaaccagccccatccccttcgacgccgctggactatcaattcacgttcgatgacggcttggcagaatacgccaggcccctgatcgagtggcatcaacttcacaacaacaaatatggcgggcttgtcgccggtgctatcgtctttgatgcacaagggcgtgtgctcatcctgcgtcgcgctgcgcacgattatcttcctggactctgggagccgcctggtggatcagtcgatccaacagacaagagcctgttgcacgcctgcgtccgcgagctctgggaggaagcgggcttaaaagctcggcggatcatgtgtgttgtgggccagggaaacgactggaatgccggctccaaactctttcaccgttacactctgttaatcgaggcggatcaaggggaggtcagaacggatccagaggagcactctgaatggaaatgggcgacacgggaagagattattgcggaaaaaatggaggacggaacgctcataccgatgacctttcccattactaaagaaaccttgctggagggtataagactgtatcaggcgcatcaaggagcggcggcagtgatttagggtcgatagtctaatatacgacttcaacataacagactttaggcgtcgcgttcttcacacggttctctttgtatgaatttatttttaagaaatgatatgtatgcaattcagagactttgactcgaatagaatttcatgtagatgtgtttatcattctcatgtgctaaccaaatgctttcactcccggctcctgtgccagaatagtagacatcattgggctgaagataaccagagctcgggtctcgactaggaaatggtgctactcgaggagctacctgagctgctagagctgtatatggacgaatcatcgtcgctgcgtctcttccgccaaaatgccagctttttcatccacgagaacttggaaagtattgagcactttggagtcttcttcttgcggcagggcattgcctttacaacagtcacccctggagggacctttcctccgaatggtggtggaataggcaaactcatgggttgcttgattgccggcccattttcaactgagaggacggccagtaggccgtaaatctcagcccgggtagtcggaatcgtaacaactcggagttgtttagactttccggcataatagcaacagatttgactgtacacgctgagctcataagaaggattggcaagcgcgagaggcttggtccaattgtaacttctgtacccgaggtcggagcaaagagtttggagagtttcggaagacacattgctgggatctggaacgagctccagaaagtgctttggcgtaaacatgcctccactagggatcgaaggaaaggttctgtaggctttgatgaggcggaagacgcggtacgcaagtgtgtcccacgcgggtgcctggcatgccgggggaagtgcaacgtcgtaaaacgcttctactcttctcagacgaatatcgagagcgcccagagtgctggcgcttatgatatcaccagggagctccaacgctgcgcgtccctctagcagggcaacagagcttgcacacttgaaatgggccttgtcgtttgccatcgttactagtgaacaagaggctcaagagaagaaaaagataggaatgacgatggatgcctatctcatccatccggccggttgacgtgatggttttaataaaaaccctggagaggggaaaggcaaggcagaaatgccatggagcccgacaggtagagtagcattcgcggaagccaataagtatcctgctcactgcatctagatatgcaaagtgcgctgttcatcgcaacaggtgtggagcaaaacattgtaaacacatcgcgattggcggtctgcctagagtgaggcaacagtagtgggtggactggttcgcattggtctcacgacgcagctgaccggtccggagcacttggaccttcactcatttctagccaatggttgcttagattctgtgaatgttgcaacagaaattagtttgagacttcacggctgctaccagacatgggggtggtgcgataatgttgtcatgtcttggcccaccagttgaaatgtctagaatgcttatcaagccacacctcatgcagctgtgtcgttcacagtcgaactagtggcagtatgttaacggtcacgttttgcatttattagtgtggcatttcctcatttgatgatgaataccagaatgtgtctgccaagaggaatactgtacacttgctcatttgttatcactgagaatcgttaaaggtaccaatgtatacatagattctgttattgcaccactattcctgccttaagtcgttattgatatgttattcatagcaccgctattcattgtgttgagttgtcgggccctggcagtccctgttgctgttgaaaccttagtctctttactcttacatattcatagcaccgtagagcttgatattttcagtgtgctcttacgttccccctcctgtagatcattaatcttggtctttatatcctatcaaagaagtaacagctgtcattttggtgaacgagtgtttccaacgaatcaatgaagaggagactttgtatatttgattgcaaactataagcgagcttttccaaattacattggattggcaccgaagaactatgctgcaattttcttctcacacctcccctgagaccttgagtataactttgcctcttgggcgacctgtctcagtcttctcgaaggcagctgaaaactggtcaaattcgaacacggagtcgatgttgaccttgagtctaccggcttcaaccatctccgtaataatgtccagatctttgcccaatggcgtgataacaaaccacagactctgcaccgtcttcttgacatccttgggacggctatcctctgggacgccgcaaacactgacgaacttgccaccgtccttgacggcgtaccacgatgctgcgagcgaggatccacccgcgcaatcgaagaccagatcaacctcacgcccattttggtcctccttaacccagtcaccgatagtttgctttgtgtaggcaatcgtttccgaggcgccaagctcctttacatagtcaacgtttcgctctccaaccacagcaatgatgttcttcacaccagcctcccgagccagctgcaccgcccaacttccaaccccgccgctggctccagtaatgagaactcgttgctttgcattcttctctagtgcagcgttgtcgcccttgagggccagcttatccaaggtgccctgcgtaaacaagccctggtagccagtcaaggcgctgatgggcgtggctgccgtttctacccagttcaagttcttgggcttgatggccagttcagattctcgagcgagcacatactcggccgcgcaacctgggcggttggcattgatccttgcatacacacggtcgccggtcttgaagctactcgtgcacggggctgagacgacggtaccggcgaggtcctggcccggaatgggcgtcttgtcaggaccgatgaattctggagcccagagtgcccagtccagctcgcctttgcaaggtgatgtagcatgaaccctgacgagaacatcttctgggtgggttggaattggaacggtgatctcggatgaaatgaggttgtgggaggttttgtcgggctgcagaacagccttcatcttgggagggatggttgcttggtcggccattttatagcagagtgtgtagttggcgattaggaggcttggtgagatattatagccagaggttcgtgacttctaggagagttgtatgaactgcaggaagttgaactgacagctttcgagactaagattttgtatttaaatatcatgatttatcttccgccacccatcacttgcgactgatccagaatccggaactcgccctatgtgagtgtgcggctgtaagtgcagcgagtacccgcattgcagatacccgtgccggatctaggcaagctgagttcggcaatccgcgcagtagctttcacgcgggaaccggcccagcaacagtggagagatgttcgtcagaatgatgaatgactccaaatgacatcatgtgatggtttaaagttttgatgataggatactcaatactggtgtgtgaagatatgtatcttcaaaggaggttagtagtgttggggtagccgcctggttaacgaatacacgtcactttggtcaaatcaccattatcaatcatgcgatagtggataaaccctaacactagatgggtgtcacacattttgtgggcccttccaatgaaggaatttcagagcttagaaaaaccatatcttcttacaaatgaaatggagctattctccctatatgaagaaaccgctatttacttaaccgaggttatcttcctgcttgtggaaagcttcatttaagatccctggccctgatcaatgcgcggtacggaccaacggaggttacggcttgcggattaactggtcttccgtaaaataaccccacgtgacatcgcgttgtgcaacaatgggtctggtgtcccttgtcgattgagggtagagtagcctaactagggttcacgtatctggactgccttcactattatttggggaggatcattttccagagcgaacagcccagaatacatcgtgcatacgggtcttctgtcctggagtaaaggtgtctctgcatggatctgcggtgtagtccatatagttgtttaccatgtcagtgccaggcaggtcagggcatgtatccttcgtgccaagagggcatgttccgtcggcagaggtaaccttctgggctggggtgtcatctatataatcgccctctccttcgcatccacctgcaaaaacatgaaacagcccaaaccaatggcctacttcgtctatttgacacctaggttagtaataggtccttctccatcttgaaatgtggtattctaaaaacctctacatcgactgattggaatggctggtgggggaaaaagttttacttacgaataaggctagttccataggcacggtaaggtgcgttttgttcgcccaggagcacattttttcggaggtggcatccgtcgaggaagtaatcagactttggacgatcaggtttggcgaagttgcaaaaggctgcagtgcctatgagatcctcatagtagtaaatatgcagagtttcataggaacccgttctggtacgcttccaataatcctcggtttcgggtgatgagctaagaatttcattctcggattcatctaggttccagaccgaaagaacagcgatagtgtcgttgacctcgcgagcgatgcctcctagactgagagtgatcccgtagagggcatctagagaaataagtgaattgggtcagttcttgttcgaaagaggttatggagacaagatgtgacaatcgcgtgctgccgacttacaagtgtctttcagtaactcgaattgtgccttgacgtattcgttggaagccgtatcctctgtagagttggcaaaaacagcaatatggaagtatgcggtgacttgaatctcagcggcccccccctccagggattgagatgacacagcgccatctctttgctgctcgataaccttgacaagagagctgggtgtcccctttataccacactcagagtccgatgacctttcctgaagagtttggggcaaataagaggcgactgccatgaaaggcaatgccgcaaaaacgagacttcgatacagaagcatagtcaataatgtccgatgtcctctgtgtctttcttgtgttacattataacttcttgaaatttgctctctggccatcggcctttatatattcctcagaccagccacacatcaacggcaatttattcgcatgatagtgcttacagggaataaccgcactgaccagtcggagtttgcaccaactacgacctgagctatgaagcttgggacaagcaggaatcgctaccaccgtaccctccacccatcaccaacccaaccacgaggtggttagtggattgacgaaggattctattcacgctagtcatgctggtatcggatgctctggtggctctggcgtaagcagctggccacaaaaccgacagtcgctggggatggactcaatggtgtcgccgggtaccggttcgcttctatgaagcttgtggtaccggtatgtgaaatttgggatccatgacaaggcattattttacatcggcgccacagcaatacctttcccatcttatccattgttctgtgttgagactgaccccataatctggtaagctctcgcctagctacccgaaccgctcagccaaaatgcaacaggtactgctattataccatcttcaagtgacataattgccatggctagagtctcatgtctctccttgctaatcaaaattttgcatcgatgtgttgctaaacggaccaaccaagcgagtgaacgaaacacggtacaaggatattgaccgaaacctccgccgcctaatgtcccatgactcaaccacccttcataagacttgggccgctctttcgccgattctacaaagctctaattttgtagcgcgacgagaaaggccgcaagacatggttcgcggtcgtattagatgtttaagccattctcgggactgcgaaagcgcgacccctaccttactaaagtattcccgccaatcactgctatgctcgccgtaatagatgacattaaacgtcggcagatttaggtttttcggtatgttccatcggcaatgtactattatgtacacgagccgtgttgatccttgttaccaaggagcctggttagggatctgttcatcaaagtcaagcttcaccccataaaaccaaccatgatcattggaaggttttactgggcatacttcggcgctattcatgagataataaggatggagacgagaacaaaaatgattccacataccgcctaggctttcaacccgtcttctgccgagtaggtgggttttttgttttgctctaatgcctgtgcgagtgccttataagttgatgaagagcatatttcgcagtctgttctttttaaggatacaatggattatcttgccacccttgacatggcgcagctcaacgtagttcttcaaaatcactggacagattcgccaatcctctttgactaccgtgttattaaattacttgaggaagtcagagcaaataaaatgtattacaatatgaaaccctagcacgtcgctctgtttatcgctacctttcttgattgaagctaatttagaagtttgatagctgcaaaagcctcagctgtcccgactagtcccttgatacctagatcatcctttgtcacgacctgttctaccgtgctagtgaatgcctggccaccaagccggttcatgtagccgtgattgatgttgagaagctccccccaaatgggatagatctttgcataatcctcctctgatatctgcaagcaatgggcccggatcttatgaaccgacgcaaaagtggccacaagttcaccaattgacatctgctcaactaggccccgaacgattcttccaggcagggtcttctccggctggtccaaaattgccttgacaaacagacccacgttcgtcctttcgtctcccattaggggcaacaaggttgtagacggtgaagccccaacgagctggacatacagcttctcgccatccattgagttgatggggctcggctggtatagaggatagttcatatttcctgcgtaccatgaaaaccaagcaaaggttgtcttgctcaatagatgaggaatagatttgatgtgacgatccacccggtttttgctctcgtagtacgggaccacgatcttcccaccgctgttttcatgggagttcggcaacgacgaccacacgtagtgcttcaaggaatcagtcgcagccgcagcatttgcaaggttgatgcctttttcgctctcgatatccattgacttgtagatgccggcggtcacaagaggtccgaaataatcggtcacagcgaagattgcatagctccccgcgaacgcagagagaagagtgtccggcttgttgatatctgcctcaacgacttcgacacccttttcagcaagtgccttggccgcatcactcttggagtctcgagtgatggctctgatagagtaggagggctcgttaagcaaggctcgaacaactgagcccccttggatgccggtagcgccaacgactgtaacaatcttggccatatttcttgtttactgttgctctgtgatgatttagtaatgttgttgttgatctgtggtgagtgaaatcgatgctgcttctctgccttgtcttgagcgggcccaactgggtttttaagcgcagtttggaagaaaccaggccgcgcaacatctcctctattgaaacatggattaccaatgaatatcctcacaaaccgctccgattctatgtgagctctcagcttagaaatacaaagccgataacctccacaaatgaccgtcttcaattgccggcggtggtccgtgttgtgcggcggtcaaaagtggatccccgcacatcttggcaaccggtatgactctcactattgtatggattatcttaaatagccctagatctttaatgaaaactactgtaatgaatctcatcttcatcttcaataattgagaagacctcgtaagactaccagcaaagcaactagccaacatggtcgtgaccgaactccttttcgtgtcctacaatctggaccccaagttacaggaggaactcaagcagaaagcacccgagttattcacacactttctaggggtcaatggcctacagtccttgtcacgtggaaagatcgtggctgataatggcacatctgtagactcaggcagcggtagaagtgctcttgttttgggttcgtcgctatcaatccgtgaggcatggtgtctgatagagtatgctgactggtttcattgatagagtgggataacaaatcctctttccacgacttctttcccaattctccggccttccaggcatttgctggcacgatgaagccattcgtttcttctcctgttctgcctgaactttacgaatcacccgattcctcaacttcgtgcgcttcggcaaatattactcaaattatcaaggttgcgcaaggcagcaacactgagaaggtatggggccagataacaaagactatttctcagtcacagacagagacccctcactttttccatggaagcggtatagaggagcagcaaggtaattttctgggcctcattggctggcctagcctcaaggtaagtaccatatttctgacaacagcatcttgaaagtctatagctaagtgcttcgtttagagctatgaggaatcgagaaaacatgcgactctagtcaaattaattgatgaattgagtgccggaggcaaactctacgacgttgccgtggaccttgcgtctattccaatctcaaagtagttgagttatgtcagcctagcttccttgtcggaaacaaacgaccgttatggcgtgtggctattgcagtagtgctaggaaaatctcgcctccttcatagatgtattatcacataggtctctattagattatagaggaattactcaacgaaacgtttaatagcacgcagaatatctcatagacaacctgagctgagaattctaagaaggcgagtccacaacaaaaattgccaggaggacaaatcgccagcatgggctacctccaatcgatcgaacatgtgtcttaagtttcagttctgcacatactccgtccatgtcaaatctgcgttctctacaaaagtaccaaacaagaccaaatccttgaattcttccgtgtctttttttacttaggcggcttcgaggtttatggaccaagcgttcatgtctcaaagtgataatatcgaaaagattaaatggctgtgtcgtctggccgcattacctttaggactgaccttcaatttagcatgtgatgtatagcggccctatctcaacggtaaataagagaaacctatctaaggctctctctccctctaacctttaattgtcgatatagtgaccgaacttgcattactgtctactatacctacttttctgaccaggcacttggccgaagtcacttgcacacagcaacaaacctcagcgctgtttccattataaaatttcaccttcgaggtccatcagaggttaataagcactcatactttgtctatgcaattaaacttggctttccgggcttgactggttatcatggactttgcattgctttttatcagtgcagatcttgtagagcgtgtttaagttcatccgtcaacatgcacagtttccagcatgttcgagtttccatatatagatgaaagtgaatcagaccatgattcaattcattcttgactacaaaaatatcgagctagaaacgaagcaaagcgtggagctcacctagccgccaaaccgttccttgcatgattcagatgaaaccagcctgaggatcactaccaagtctagtaacagcgggatgatagatgctctattggtagtagaacaaaatagcgcgacaaaacagattattcagaaatcttactcctgacgcctcatcaccattgccccaaagtggttgcattactacgtaattgacgccaagtctattaatagacaaatatgtacgtggtgcatggttcaaagacaggatttcagcgcccccaactgaggatgcagcggctatctgataagcaaactttcagaaacaaggtctggagcatcacatggcagaatgcgttacatcgtttcgactaatgcagcccattcagtcctaagttggagttgggggagtcagcccaactggctgaccaaagactccaccagaatgcagcgcatgcattcctgctgacaatattgatttcccaagcatggccccttcatttcttgttttgtaattttccaaggacacttttcaatggagtagagccaatctgttacctcaggtttactcccaagttgggatgtaggctcctagttggtttatgaggcgaatgatgccaaataacgtggctctacactgatttgccgctatgcctgcacgcggcgaaacacatgatggaaaatggtggaagaaaatcacggcgcggctgatggcccaagtcccgaaagccaaacacgatagcgagagcgacaagcaacagcaaatcgccgcgcagcagggtcagacactacagccggcgacagcgccggatatgaacaggatcacatctcgtgatcctattgtagatccagaaacgccgcattctctcccagctcaatctacccagaacaatctttatggcaagagggtagattcgcttcgaaatcggcggccgcgcaatccggtcgccactcttgaagctgaatccccggaaacaagtacgtccgtcgaaaatcaaacaaggctatatgctgctctcgcccatgccacccacgaaggagacgaagaattagtacggacgctgttacttgattcgggggcgcgagtgcttccaggcccatctgagccaaccagagattgcggcagctttcgttgcacaattcagcccagccctttgcacgaagctatctccatgggacacaccaatcttgcgagccttttacttgatagattcgtcctcaatggcggccagcatggcgggccagccagcggatccgaaaagaggcagttggccgagatgagagatgtgaaagggaggacacttctggctaccgcttgcgtagcagggaatgcagaaatcgtgaagaagctgttagatataggcgccaaaaccgaaatccgcgacagaaatggcctcaccgcactacatctagcggctcgctcccctacaccttctccctctgtcgtcaagttattgattgactatggggccgataagaatgccaaagatgacagttggataacactattgcaagatgccgagaacaacttgttgcctgaagaagtggccatacttctaaggccagccgcctcaaccccacgaccgaagcaccgcaggaaaaggtcacgagttcctcttcccgagacgggtgtgaaccacagacaggtgaattcgaataatggaaatcaggacaaaccagacacattgtggctagatggggtggtgatacgccacagtgagcgaaaggtctcacctccgcactagcaagtcatttgggatacacttcatgatcgtggattttgtaggtgtatctgctcagaaatattatcactgagggagtatattcggcttagaaatgttccctttgcacatcgaaattcgcaacgtatattctggcgcatagttggactccccaatttttccctcggcgacaggtatgatcaaaggccactaagctgaaatttgagcagatatcttaagtgtcctcaatttgaccaggtactgcgtggtttaggttgaccccggccgaagttgagctcagttctttggactggtgactcagaaatctctaagcacttgagtatgttctaaaggaaacctggatacttcaaacttggttcgtagcccaggtgcagatgcagaaattggcctgaagtggttagttccttggtctacgggaacatgagccttgggcatttatggtaatattgatgagaaattaaacatgtctttttgcaacacgcttgcaaaatagagtagaagaattaagcagaaggggctcacgtgatgtatcttagtcgtgttgttctttagacttgggccattgctcgtgtgtatctttctcgtaccggccttgctagaccaactccgggcccaagttgagaagaactatctgcatctatattaagattctgatgcagatcttccgttgcagagaatcactcgggtatttccatcaacggataatgactcagcgatgagttaagacttggtaggaaatacacaagccatgagctctcgatttcggagttgcctgcaaagacactacgtgtgctacgaacagaatcatggcaatagaaattcacagaaaaagaaaagaaaggggaaaaagaacatacctatcaaactttaatcagcgagcttctcaaccccgtcccggcttcggggtggattacatacgaggaactaaaccagcgcatctttgatccgctccaaattgccagcctttttgaggacgtcgcagccttctaagtcaagttcaggaaatcgcccacctatttactagcctctaaatattacctttttcatgattaatcgtgacgagatgccaataaatgcagatagtctatacactaatctccatgagacaatcccacagatatatctagcctcaacgcccgtcagtcaataatggtgtgataggaggggaaatggtgcaatgcagcgcataaaccccacactaaggtccaagccaaacagaacaacgccgggtcttaataattatggtagagaccgatcgcggcgtcaatcacgacatcgataggtaaactgacgtctcagccctagatccctatctccgctcaacctgactagtgggacgactagactggagaaccattttctatacaatacgggtcgagccaacttaagatatcgctcaacaatacatcccataaacttcatcagtattcagacagcaaagtcggaaaaatgccttctgcagttcctgtgattcagccatatactcacgttcctgaaacaaaggaaaagctcgactgggcatcatgtaagcagctataaatgcaacctcccgactgtggtaacaattgatgtgattaacaaatttccccccatagtgactaccattgatctatcgaagtatggaacgtcagaaggcaatactgaactatccgagacccttattcaagcaatcaagaccaaggggttcttctatgttaccaactttggaatttcccaggacgatgtagatcagcaatttgctctcggccaggcgttttacaatcttcctcttgaacagaggctacagtataccgccgacctggacgcaggaaattacacgggttatcgacctgcagggaggcgacgattgaacgggggccttccggaaaagacagaaatgtggaatatgtctagtaggttgccttaaacttttcccccttgtccatcgtaccaagccaacaaaattcggatatcatgatctgttgacataatacatagcggaagatggtcaggtcaggcaacctcttccgtatccccttgatggctaccggaacgagattgaacaattttccaaggttagatgcacccacaagcagatcaaattgtcaacagcctaacatcctttatccagaacttacatgacaagatcttagaccctttgaaccatttgattgctctagccctaggagtgcctgaagacacttttcaaaacttccataaatggaacctaagtgatgaatcacacttgagatatatgagatattctaagtttacacccgaagaagttcattctctgaaggataacctttggattcacggacatactgatctgggatcttggacgttgctcttccgccagcctgttgcgggtcttcaaatacgtgatcccgcgtcgaatgaatggaagtgggcaaagccacttaatgcgagcttgacggtcaatactggcgatgccctcagttatttgaccggaggctacatcaagtctaccgtccacagggtaagttatatttctccaacgaaacgtgaacgaggaaattctaaatattcattgacaggtcaaagtgccgccaaaggatcagcgggacgttgatcgtttgggtctaatgtacttcagccgtcccaggaacgatctgccactcaagacaattgagtcacccgttcttcaagaagcaagagcgaagaatgattttgagttgggcggacacaacataccaacaatggaggaattcaccaagttgaagcaaaaatggaatcaacgtcctgggttgagtgaggaccaagtcgagggaaaggaaattctccctggtgttattcaaaaacgcctggtttagttgcagttgttattttgtaagggacttcagggttttgagtaattgaaacaggaacaacttgttatttataattcccggagatccagatcgtgcaaattgaaggaatggttcattgaagcatttcttatttaactctatccattagcctagtctgaagggcattccatatcacaacgatcccaaggccgttctagcctagatctaatggcgattgtaactaagtgaagggttggataatactccgggcattttacaatgagacacgatggaaaagtataattgaatcttctacgctcattagacctcctgcaaggttgtagccccgattgccgcgccagaggtgggaatcaagaaattgcttccttgcacctttccgtttgatccacgggaccctttgagtgtgccagcatcaacactcttgaaagagctattggaccacgtagtggatgaatcccaagagtttccagacgaggaaaccgagctaataaggctgacctggctgttggtattgactgcagcaatgttcgctttcatcgtggaagaggagcttcgcatgacgtagccggtatcgccgttgttccacgccgtgttgcgctcaaatgtgattgatcccgggtttccgttgtcgataaaccctttcttgaagtttgaaaaggcgattgaattgcgtacaatgtggttggccgcggggttgccagtgatacccagcttgaaaccatttccatctccttcaaatggagaaaacccccaacggttgtagccatttccccaggcgtatacctcttcaagggtgacgggggatccaaacatgtaaaggtccagtccgtcgtcaacgttatcccatagacgagcattgcggagaacattgccctctcctgttccgtctttgcaagcaaaaccatcggcactttcgccgttcttgcggggatcccgattacggtatgagtcgaggttcaatacggtgttgttggcagatgcaccctcaagctgaaatcccgtctcgtaattattgtgagtcgagagtccctcgtagtaattgtgtgaagcatcacgggcataaattccgtaaggcccattgatcaacctaattcggttaatatttcatcaatgtacatcaaacttcgatccgatgtagacatactctaaattatagaacgcccaatagttggcattctgaatgtgaaaaatgccacgttccttgttggggagactttcgccgacaccatatggcgttctaattgtaacactgagtgagcacgttgcttttcgattaaaccgtcaaagtgatgtccaacttaccctggcatgttctctccattaatgataaccttttcactttggtatggcttaacagagataggtgatgttctggtaccgctcttggcgacctggatattggccgatgggctataagttccagcccgcaagtaaatggtgtcgcccgccgcggcagcgttcacagctgactggatagagccgtaaggagaggtcgctgagccgtcacctgagccagtgggagaaacgtaaatttcgcgacccagcacgagggtgctgatgccgagcacgaggcttgttttgattgtgaacatgatgccttccgcaatcgactaaagtatttgtagaagaagccctcggattctgtgggaattgattttagaccggtattggccttttattaaatcataatgagcccgggatcgacataaataattgtcggtgtatctggcccacacattagacggcgaaacagttccaacgagtttcccaaacagacctcggagattggactccgagaatataagatgatatcagggtcaacgtccaccacttagtttctccagaacacgcattattggtggattatggagaaccgccatgcattcacccgcgagaaaattggtttcgcgatatgtggaacgaatgcccttatcattcccgattgttcctgatgggctactcccacttcccggcagtcacccgcccttgcacagccaaatcatctcagcgttgcacttggaacatttctcccgtctaataaatggcgattccagctggtgctaccctgccacacggcgaatcttgcattgacgcaaaatcaatcctccgtcctgatcaatgggcaagtggtttattctgagtcatcaccctggtgcgttcaactataatgtcatcgagtttcaggtcattccactagcaatctatccaggtgggtaacttgatggtaagcttccgaataagcttcattctattattacgaggttctaagatatctcatgccaacgtcttaagggcattataaattggtcaagattctttgtgacgacgtgagaaactttgcttccgtttgctacatttcgttatttgttgatcatggactttaaatccctcttgttacagttataagagagggtatcccagataatctttccacgtgcctccgttattctaacgaattgtgcagcttgtcaaatctgcactgaatattcttaggttcctagcgcatataagatcaactcgccagtaaacgaaccattgcgtgtggctttccccctttcagttcttgtatgtgctcgagagaccattcatagaaaacccgataataccagaccgatctaaagaaataggatcaaatgtcaagaatccctcaagcatgacgcgtgtaatttgatttgtctttcgcttgaaaggtatctccaaactaaagtgatgtgctctggttaaatacggggcggcaagtcaaatcaggacatgctgagaacatggatgctgaaacgcagttccgggcttcccttggcttagagcatgagtgcgccgagacgtgctgaattcccagagccaaatgacatcagaccccaaggccattatagctagaaacagaatgtgcaaaatgtccgataagtccatcacctagtaagctccgctccagcagcacagtgcatcagttcaggttcacaaacatttccacatgttcagcagtggctgcatactagagccgatacatggtatttggagttccaataacttctaattaggctgcaaaaacacttcgtgacaccaagtacgggtaccagctttactcggcgtcgtttgcatcggccacagctctctaagtaggcttggtgtaaaaggtgcgtgacatgggatagaatatatctgttgggttatgtggttactgagatgacttcttgctggggctccgggatttcgaatgaatcatattgcacgctcaccaatgggcctctacctattaagaacccgctgcagaaacacgggtcgtgaactaattttgcattaaatcaatataggagtcatttcctcacaagcacctaatatctaaacctggcgtatcaagactgggactttcagataaacataaatctacatcatcatgataatagcacccattgaagatcagctggaccggagtgagctatgtagaaaggcgacatcacgaacgttcatgtatttgacagttatcacctcggacagcgtcgagatgttgtcattgaaggtggccttgttaggctcactacgacaatcccagaccaggtggtcaatggcatgaggaaatatatggtcaaagcaagggatagatctcttgctcttctactagacgaataatctcaacccatttatcttacgtataggttttgtttcattgtgtaagttggtaaaccgatgtctagggtttatagctggccatcgtgtggctcgtcatcatgcagtactcattttatatcgtcccttttatggcagaatccccatcacgtatagtaagtttcgcttcgtagattagccatgccgtgtggttgtaccaatttccgtaagttctagaccaacattcatagtaaatttcaaatgtctttttttacagcagctggtaccataaagtgtataggaatgcaatttccagatgaagtattataggatctactcgaattccattattacgtggattatgtttaaaggaacccattcggctatcacgcttgaacaataatcctccacttcccttacgcctagatgcctaccttcggagaggaaacgtatgctaaaacgactacgtaaacaactaggtagatattatagcatttttaacatatgtagtttcatataaatcaaaggtccaaagtgtgcaagttaaatttcccagcctaccgggcggtagatccagcgtcaaggtttctagcgggcatagttagattcggcatgactccctcccgaaagtgtaacgcctctgcctctttttactcatcgagccgtgcaactaagcgagtgcaggcgctatgagatggccacgcatttataaaagaggagctcggtgagggaacgatgagagaacaaggccatcggtgcagttgaggtaaggcgctgtaaccaccctgctgactgttgaaggcagggcctgagaccgggcataagctgtcctctgaggtgattcattggttgttcaccagccattggaatcacaccggacgcacaagatcttgtttgctgcattatcggcttacactcgcgcccgagctcagcctcttgtgcagcgctgctgttggccgctggcagcactgccacgtcactcgagcagcgcctagcagcaggcagacacggccagtgactaatagaataaaagtaaaggcgtccattgtgattagctatgactatgaatgagtcgtgccccgctgtggaacgcgccgggctcagcttctgcaggcattaaccaccgtcatctgcctcgcgcgcatccccaaacaaccatcctccatgcttcccgcgagctgaccgacggtgcgcattggtctcttcagacgccccggatcgctttcccatcctgctgccatgcctcaacccggcgacagcgccatggacgcagacagccccatcatccctgcgccggactggttcctcaggaactgcgtcaagaccgcgcccgagatcaaccgcctcgcagcgcaaatcaccctgcgcggggagatgaccagtaaagatcctgtcccgaaggatccaaaaccgagcgcaaggtcgcgcagtgaaacggacagcccggccaagaaagctgccagcaaccggtacgaggtcgagccgtgtatctacgatgagctcctaggacttgtcgcggcaaagtcgaaagagggcgaggccgcatctttcacagacgatgcggttctcttaaggcttccagacaacgactatccagggcgcgacttcctggtgtccatggtggccaagttggccagtgatgtcgaggccgatatgattgtcctggatattgacgacctgcatgaccttgcagagcacttctacctgtgtcagacccctaagcccccggcaggaaacaggggatctcttcactggtttttgaagcccttaccgaaaaagcccaagaagcccaagaagaaaccgaagacggattcaggcttgaatcctcccaacgattccaccccggcatcagatgccgattcaggctccgactccgattcagattcgggcacagattcagatgcgagcccagactcaggttcaaaatccgacgcggatacagattcagactccggtgccgagtctgttctatcgttagattctacgtcaaaaccacccaaacccaccagcgatcctccgccgccacctccagccacctataagacgacatatctattgagccataggactgataagatggcgtctatatactctgggcaggcgttcaccccaagaaggcccatgacatcgcgacatgcgcttccatctctttctcgggcactctcgcgtactgtatccgagtttcggacgatctcgtccatattcttatggctgatggaccttaggaagggccgcatccgaccgccagagccagcggaagatttgaagttgcctcctgtcaagaatcagattaaggagaatgctgccaccttctatcgtgccatcttgtcctcgccacatgcccgagcggctctggacgaggaagacgcagaggccaagaagaatgaagatgatacgaaacaagttgatgataccaaggctgatgatatcaagactgaattcaaggcgaacggagtcaatgaggctgagaccgcggaggttaacgccaaggtgaatgggatcaaggaaagtgaagccgaggaacacgaagccaacataaacggagtgaagaagattgagattcaggagaatggcgcggagtcgggcgcagtcaaagagaacggggtaaataccaatggagtgaaagagagcggaatcaaggaaaatggcgtgagaaatagtgaggttaaggaaaatggaatcaagatcaatggagtacggaaggaggaggagaagaagaaaatggaagcagagctgaatggcgtgaaggagagggaagtgatggagagcgaaatgaaggagaacggagtagtctcggatgaggagaagaaggctagagggaaagatgatgataagaaaaatagagaggagaatagtgagggtaaggataacagtggcagcgacgacaagagcgtgaaagtcccggggggtgaagcaggcaacagcagcgacaatccttcaacacaacagcctcaaccccgaggccatttcactttccaggaccccaaaggcaagaacgctcgaccaatcattcttgtcatccctcagcttgaaaaattcagccatgtgaccaacttcgccttccgaggcctcaaagcgctgaaggcaacatcgccacacctcaagaaaagaatgatcacgatcacaacgacatcaaggtctgacaaaccgccacccagctcaggaagacggtcggtaagcctgtttcccgactcgccttccccagcagagctcccccgagtcagcgtgttcagcgtgcggcattttgggctgaggcccaatctgttcgaactattcattttccctgtcaggtcgctggcacaagttggttccttttctcgcgataaagatcttgtctcccagcgacacagcatcaggagactccagagagagatgagggtgcaggagaaggacagaagcctaccccatctacagccatatgcagaatggaatattcccgactccgaatccaaccccatcgccaaatatctcagaggcggcaaactccacgctatccccgagtcaatgaaggtaggggatttgttggtgaagacaaagaaagcggccaagctcgaagatatccatgcggtcctcaagcaaagatcagagggatctgaggcgctgagtaaatggaacgagagagacgccaaagggggctcttcggccgacctacctccacgtgtggttcgcgtcatcaagagggtcacagaggaagctgagcagtcttacagcgagttcaatgcggatctagagattatgaagactctagtacatccaagtaagcattcctaaccccaggcacccccaagttaattccccttctcctagcattttctaaacacgactctgtaggtgaactctcccaaggctggtcagacatcgaggtcgagcccgccatcaaatctcgcgtgcagcgcatgatctctctcctcaaccgccgagcagagcttacaggaattctcaagaagagcgccatgggaggcgtgatcctctatggtccacccgggacgggcaagacacacctcgcccgcgtcatcgccaaggaaacctcctccgtcatgctgcgaatctcggccgcggagatcgagcgcacgtgggccggcgaggccgagaaggtcatccaggccctcttcaagctggcgcgcgagatctacccttgcatcgtcttcatcgatgaggcggacagcatcttcggccggcgcaaggactcggacaagaactgggagcgcaagatcacgaaccagctgctgggcgagtttggcgggttcgagaacgacatcgcctccccgctgctgctcctggcgaccaacttccccaacgacctggacccggcggtgctgcggcgtgcgccgaatcgattgtacatgggcctgccttcgacgccgtcccggcagaatatcttcaagatctgtctgcgcgaagagaagatggacaagtctgtcgacccagaggagcttgcggagaagacgagcgggtatacaggctcggatattgagtacatctgccaacaggcggccatggcggctctagaggatttcgaaaacggtggctcggaagacagtgattcagaaggaatttgtctgaaaatgtctcacttttcccagaccttgacaggagcaagtccctcagtttcgggaccttccatgacgggaattgaatcattcgcgagagagtatgatcgctccgcagtggacatgatcaagaggacgactgatgatttcggcggcttcagctcatacttgtacatctaaaataaaattgtagaagggggaatctcaaaatcatgatagatttgtttacgtaggtccttttcccggccaaactgtaccacttagctcatataaatcacagcgataactacaaataccactgccatcactccatcaacagcacttctaggccaaaatcgtgacccggcactatcatcattgcccgagctcccggtgttagttgaattaccaccatgttccagtacaaagatttctccagtactatcagacgtgagccacaggcgcttcttggaatcgaacgcaaggccaacgggtcggaagcagctgcctggacacttggacaggtcgggattcgtcagtaagtcaacggcggcatcttgactgtcgttggcggccgtgggctgaccatctttgaaggcgatgctggcaacacggtacccagctggctcatctcgattccctagataggtcatcaatctatcagtcaatgtttcttcaagaccaatcgtgtcttattctcctatggagcaggtatcacttacagctgccgtggaaagagacgtatgcggtggaaccatcatcggcgaatttgatatcaagtggcgccgtgtgcggaggaagcgcaagacgcggtgagataaaatccgcgttacaggtggtatcattcattgaattttcggcatcgtcaacagcgaagctgttgcccgtcttgagagagccgatgttggggaaatcatccgtcctccagaccgtgaagcacgaaggatatccgtaattacgaccatcaggcttctccgcagtgccgtgatagttcagctcctctccagggttgtcgttgtgaatatcctcgccttggcgttgcagctggtcaacggagttctcgacagaccagatgccaccggtggaaggatgctcagcaacaccgacagaattgcgcaaaccccagccaacgacgtcgccatctgtgtactcaattccgtcactgttttcactgagggaggaaatgttaaagctacgtatctgggaacggcctgagccgatctcgagagtgcccatatccatgttgccgtcgcttccgcgggagacgagaaggatgccgggctgtttttgggacgcaagaactgtacgagtggtatgaccaccgctggccatgtccttgactagtgtgcgagaggtgccgctcactttgacggatgtgctattgtatccccaagataataccttatcagacgtagaaacgtaaatggcgctaccatcggaagatagagcgacgccatggttaagctagaaatcaggaaattatatgtcagtaagcagatgctactgaaggcctgtctccttcaatctaaaccggctcggaacactctcatctagcctacaatctcccttggaaagaaatggtaaacgtacgtttcgattgccaatcagcgtcgtcttctcgctcactgacaaacatgtccccccatcatccttcagcgtgagatggatcaagcctacaccagaatcaaccacgagcaaaccgccgtcgttgtcgaaaatcaggccgcggggcctcgtgaagccattggcaaccagacggaacgcccagccgtctgccacagcgggcgtgggatagccgacggtcagggtattggcgcagtcagcagcgaggaccacgctgggcagtcctgccagggcaaggaatggcaatgtgcgcttcaccatggcgtgagacgattggcacagcttggacaggaattcagatccgggggatagagaatatgcaaggggcaaaaatgattcatgattgctcatgattagttaatgcgcgtcgagactccacgtgacgcatcgtcatagaacttatgcgtatgtttcaggattcgtacatgttaactaattgaactaaaggcgggctggcgtggatcaattcttaagcttaattgattcagaatcaacctgttttcatccccagaaagggccacatcgcttattgattcccaggatgtttctccgggaatcccggctagatctttgcgtgagacaacgcgtcatctggctgaatgccaagcgatgatcgcaagagctcaattgcagggggtcttgcaacagctgagccacaggatgatcctgtacatttagataacccccatttccccctggcccaatcctcctggcccatggctataaagaaacatataggcaggaacatccatccattatccagactatagaaacttctctaggccattcagtgtaagtaccgcaccctgagcggcaaaatgttcacgtacaacaaggcaacagatcattatggccgttcccaatgtctctcaattacaatgcattatctatcacatacctttacatcatgagtccatctctacgcagacttgcccaagctcttcttgatctcggccacaacggcggcggtaacctccttcgtcgtggcgttgccgcccaaatcggcggagaggacgccggcctcgcacacattctcgacaatctgcatcagcttttgcgcggcctccccctcgccgagccactccagcatctccgcggcggtccagaaggtggccacggggttggcgacgccctttccggtgatgtcaaaggcagagccgtggatgggctcgaacatggacgggttctcgcgcgtggggtccaggttgcttgtgggagcaatgccgatggagccagccagggcagcagccaagtcggacagaatatcagcgtgctaaaggaattcatattagccaaagaagatacatgcatgaagagttgccttttcacagcacttgggtctactcacaaggttggtagcaacaatagtgtccagggtctcgggcttgagaaccatgcgggtggtcatggcatcaaccagcatcttgtcgacagtaacatcggggaagttcttggccacatcagcggcgacctcgtcccacaggaccaagccgtttcgctgggcattgctcttagtaacaactgtaaggagcttgcgagggcgcttctgggcagtctcaaaggcgaatcggatgatgcgctcgacactgtggcgggtgaagatggacacctcggtggccgtctcccaggggcgaccgcggtgggatcgaccaccgtggccggcgtattcaccctcgctgttctcgcggatgatgacccagtcaagatctccgatgttgcagttgcggaggggagactgggtgcccttcagcaccctggtagggcggacgttggcatactgctggaaaggctggcagatggccaggcgaagaccccatagagagatgtgatcagggacgtctgattaaagttgattagttgccaaacttgaaattctatgtggccatcgttcaaaaataagactcaccaggggcaccgacagcaccgaagagaatggcatcgtgcttcttcaattgctcgagaccaccatcgggaatgtactttccagtcttcttgtatgtgtctgaactccaatcatagtgggtgaagtccaaatcaaaggactgtagagtaccagacaaggccttaagaacctcaatgccagcctcaacaacctctgggccaatgccatcggcggggatggaggcaatgctataggccttcttgacggggttggcgctgggagacatgatgaagatgatgtgatagagagttgtttatactgaagtcggcctaaagatggagaagaggtgaggaagcaaatagaagcatgcacgacatcaacttccaccaactcttttttatggctgcaggctcgctgccgagcccggaattgcaatggcaaatccgtcgcatgtctcctccctgtggggattcgggtaatgtgttgacttggcgggtggaagactgactgcggacatttctttgtccgcctggcgccatttctagaacttgcattttttagtcatctgtcagttagccaggaaatgctcttagtttcgggcatacaatcagccgccacttaatgatgttcatgttcgtttcataaacctacctaccctacatcttaaagctccctaccaaacagcatttgaatgcttcactatctatagattcgctcattgtctagagtacgataatgatctttgttagtcttgcattgatgtggtatttcattgtattgggcattgatcgattttgttgtaccacaactcatatatcaacatgtaccagatgtagttgctctcattttccttaccatattttgtaaacctatgcaaacttcatttcagagaactccattgtaatatacattaaaaatccgatgccaccaagaatgggttatcaatagcattaaaagagctggcaaacagctgatcataccagatcagagagtcctgcccctcaagaggcccggtagcggcagaaccacccaacgtatcggtaatacccgaattaaagacgtcaaaacgattggaattaggggtgttgatgttgtagctaacgcccggagctatttgtgtacgcggctgcaatgatccgtgagactcgggaggacctggctgcggcggcgagatactcggctctgacaatgcgacggtgccgtgacttcgctcgtgagtctcacccgtgccttgactctcgtggaaactgtgtcgcgtaccgctgccatctggcacgccgcttgatatgttccatctggcgcccgaggcaggtcgtttgttccgcggaccaagagttgctggctgggaggtgcccttgtcgatgtgtccctggtgggagggaactgtgggtggtagatttgcgatcgctggaggatggtgcgacatttcctgcaccgccgagagcagctcgtcaatggcctcgaggcaatattctggccaagccgtttgtcgcatcgccaaatggctgagagtctcctttcccaccatcgcatgccttgaagaagaagaagaagtttagaatctttccaaacaataccgatggaggggaatgttacctcatcgccctgctcagcggaacctgattctcaaaagtcgcgtgcaggagaacaaaagcgctgatccagatcgaccatgtgaatgaaggccaaaataaaggcaggccaagtcgttttccagactcgccgtttgccaatttatacttgcgtttatgccgattgaaaatactacatatggactttgccgcggatatgcaagactggaaggccgacgagtacgagggcaaagagggttcagaggccagcgcgggacggttcaagcatatcgtagactcgtgcttcagaaccaagagcatgagacggtggctgggggataatttggcacgatgacccggcttatcggactcctccacggcatcaagctcttcttcttcctcctcctcgacgtcttgtatctcgttggcccatctagccaactcgatctgaacaaccgctgttttgtccgcggtgtcctgtctctgctggacggatttgttccgcagttctaatatcaaaccccgtattcgagcgtgctttgccagaagcgtgaggagctggagcctttcaactccgtcattgtttgctcctgggacgccatgacgctcctctcctggatagcatacgtcaaggtcgtcatctcggatgtccaaagggagtccaagagactgacagagaaatctttccagtatgtaaatgcaccacaacaccctgcgtctgatggacgcgtcctccggaccaaagaagccaaagcgtgccgggcatcgatgaagcccgaggtggaacgccattcgcacaatcaagccgcctagtcgcgaagcggcgttaaggtatagcatggatgtgagaaagagctgaattgacagggctgcctgtgttgctcggattgatgctggttggctaagagcgaattgagagctggtcactgcttcctcgacgctttggaagacgagatgggaggggattggtgttgataagggcgtcccttggcggctgtctgctagcgaaatagacagtaccgatctcaggatgttgtagtccaatacagatagggatgccacccctttggaagaggcctcttcgaatatgtggaggacatctgggccatggaggaatggcaagacgggatgccaggattcgaaaaagctcttggaccagtcaatcaaggattcgaagctcggtgattgggagtcggttaatgggacagatgagacctcgttgggtttccagatcggctttctggtgtcgaagttgtctgaaggtgattgtcggagctgatcgtcttctcctgggaccaaggtattgacggcagtagtgttggattgggccgtcctggaagccgacttgcgggcaagcctcagatagactgcgcgtatatagtgaatgccactgccgctgccgacgaaacgagcaacgccatgctcaccagagtctcgcatcaatccatattcacgagggggctgggagccagacacagaccgcttccgtttccgggaatctccttgatatggcgtgaagcaggaggtagtgtcagaagtgctcaggggtgactgattagcatccattgcagccagcctcgagatggagccggtgcattggtgcatatggatccaaccagtcccaacagtcaggaggacgtcgttcggattgcccacggccattgacccgtgacgttgagtcacggggaagaatgttagggcatcggatggggtcaagatttccggacaatcaaatgtccgggcggcggggttttatttgtctatgagggccatgggttcgcccttgttctctggctgttcttcagttcaaccgtggggctcttctcgcctccaagcgccaattcacatggccgaaaatgaattagtggtacgagaggattctggtccgacccagaatccaattgcttgtaccaattgccggcaaagaaaacgcaaggtacggatgctcacacgtctaggtcccctgcagtctcttggctcttggcggtggaggagggtctccccaatgccgagcatctcgggttgataccgatgattgatattttgcaatagtgcgatcgtcagctgtatgcacgccctatagatcttggccaaggattggtgttctgaaatttgatgctctccacagaccgaattgccaacagtgcagcaatgacccggcaaactgccagtatcccgagcagagcagacggtgattgagcaatcccaacctccaacttggcccatccgtgctgattatcgatttcaaaataggggaatcccgattggtttcattaacagactagaagctcgcctagcagaaacagaacatgctctacatcgccttctccaatatattgacgaaggcacattctatccttcaaacctcgcacagacccctgaccaaagtaaagccgacagggtcaaggaatgggacagctttccattggaatctatgatggacattaggagatggcatgagcagcatgtcggaacagcaaccccagcaagtggtactcacagctcgcagcaaaacctgtcaccccatgatatggcttggcagcccggccactatagtcagggccctgatctgagcccagcatcacccttcaacaacgcgccaaacctggtttctcaaagtgaagctatagggccaccggttgacttgaatccagcccccgccgcattgatcgacccatcgtgggggaacactcagcaggcttcggagggcaaggcgaaagaattgagcaaaaatcgacccaatttgtatttttagttgagtagggttaacttcaagccagtaaaaaaaatacatgagagttaacgacgcttctgtgattgtgttggaggcctgccatggcaaattcaatgccgagcaccctcaaggtttatctgtgccatcttgctctacccgttgattgatcaatgaacatttaatataattggcctttcttagagtagtttctagcttaggcataagcataagagcctcttcaaaatatttattctgtgcctatcgagctgtacttagtgcgctggcgtgcaataaggggatgtgctcaagcagcagctcgactgaacaataccgtagaggctctcaggcccttcagtggtattctccggccagggaaccccgcattttggtccctgcagggcctaaatgtcgtggagctttgggttttactgaccaacaaatgagattccaacgggcatatcaatgacgtccgagttgttgatggagatatcattccagctgtgcaaatgccaataacgagggtgggattcacgtatttcgatcaggcagacggcgagctccggaatagcgactcgggatataataggaacaaccacatgggaggtccgacagggggggtcctaagatgcccgattgtcaccctgctatcaaagcctatcgcctctttgacatgcggagaaccagctgccctgcatgcgagataaggaagacaaaaggtaagacatggccatatcagcttgttcagcgtggcgtgcccctccctcatgtaaccgagacaagccgttgatctctgtcgtccccctcacgtcactccctccaaccctaccatcatgcctcgagccagattgacgacgccatttgtccgtctgaggacctttcccccgcgatcgcagatatccaggtattcttcaattattgcccagcgcgcctcgccattgccgttagcgacaaccagtggctgctccaaacgcccgagaattggacccaacgtaccctctgtcacgcctgagagacgacaaatcgccaggatgggcggcacagcggtcgagaaggagggccttgtcattcctgtaggtcggggaagagcgctgcgcactacatgtccagctaacacgagtcggtatagctcatcgacttctcgaaattcctccatggaacgcccgacgagcgcaaggagacggccggggagatcctacacggcttccagaatgccggcttcatctacctcaagaaccacccgatcccgctcgacgtggtccagcacacgttctcgatgtctgccaacttcttccgccagtcggacgaagccaagatggacgtcgcgtggaccactcccgaggccaatcgcgggtattctgcccccggcaaagaaaaggtgtcggagcagatggacatcggcgatattacaaaggagagagacgccgcgccggatttgaaggagagctacgagatcggacgcgaaggcgaggagaagcatccgaatcagtggccgcagcgcgaggagggaccgatggctgggttcaagaaggacatgctgagcttccatgacctctgcaagggtttgcacttccaggtaatgagtgcaatcgctgtgggcatgggcctggatgatggcttctttgacaagcatctcgacgttggagataataccctgcggcttctgcattacccagcggtggactcgagcgtgttcgcaaataatgcaaatgctgtgagagccggcgcgcacagtgtaggccatcatttctatcgccgggccgagagcccaatttgcgccgtgaagcttaccagaggataggattatggttccatcactttgttattccaagacgcacgaggcggcttgcaggtaagaagtccgacaggcacgtttgttgatgccacgcccatcgagggaaccattgttgtcaacgcaggcgacctcctcgcccgttggagcaatgataccatccgaagcacgattcaccgtgtcgtagagccgcccttcaagcagggcccaactcacccggcccggtacagtattgcgtatgtagatgccattctcccagattgctctctgtgaagctgatttgaaatcacaagatacttttgcaatcccaacttctccagctttatcgaggcgcttccaggaacatatgctacagaaggtgaaaagaagtatccaggcattaccagtggagattatctagtacagcgcttgacagcaacttattgattgctcttgtggtgttactactttgggttatttacaatggagtatattgggtatggattacaatatctatcaagttgagtatatatctctagatgcattagtatatattcgagtatgccagaagccggttgtgaatgtcatatctaatagcagtatcgccgttatcatttcatcgccagggttcgttaaggataatgaagatttcgggtcgagctgctctggctagaaccatccggatccctctcgctagcagcgaaagtggcaaccgtcgtttccaccgtcttgacaatgccgggtcccgtattttgtaattcgatgtcttcatcgtcggcttcgatttgcgtaatattggtcgtattcgggtttccttggtacacagagtctccatgcctcatgccggtgaccttggattttgattttcctcccgttggagcactcttgcccttcttcccgttggtcgaggtatgtcggtagtaaatatcgtcgcttgcggcgtggttaccggttgaccgaacgatcttggtaatgagctcggacatcttcagctcgatttgcagcttcaggaggtaacaaacaggatggaaagacagatagctggaccagttgattagaatgtgtgttgaaaggtatcgtggtttcgttataggtgtcatgggcattacttacaccatgctgtttttcagcgacatcgttccgacgagcacaacctggaacattattagcttcgccattcacccggctggggccgaagagcaactaacatcaagagagagcgaaaggaaaatgaggaacaggttcaatctgaacaatgggacgtatttggtcaatccattctggatgaggcgtgttcggacgaggtagatgaagtagccgttcaaaacaccatccacaagggcgaagatcaccttctcgcaacggtcccaaatcaagttcagatggatccaagtgtcgttgatctgaaggcgagctggcatccagatgataaacacgctgatgttcaccgccagaatgatggcgaaaacaatccacttgagcctggtcgccttccccgggaccacgatgaggagcccaagccgattgaggatgatctgaaggaggaattggatctgaaatgcccagaaaagtgctgcggaatcaagtcagctcaaacctcaccattccaacgacaacccacagagaacctaccgacgcaaaagtaaaacccgaagctaggagcgatgtagcccctctggaacccccaagccaacactcccaagacctgagacgaaaaccagacagcccagatcatgaaaacatatgccgttatcctgtgtgtgcgcctccatgaccgatatgtctgcttgcctgctttggtggcggagaagattgcgatgccgagagaaagaccccagaagatgcttgtcgtgttcatgtccacatcgtctgggacctcgagctcgtaggtgtccgggatgaggaggccatatttggcgcccatggtgagtgtttagagggcttccctccacttacggtaaatcggcgagtctacaccaacgcagcatatcaacgcggggaacaagaaaaagaaaatagggacgcatagaggggatacatagtatttgggcaaagcggaaggggcaagccagatatgactacatagcaactaggggaccgtggattctgactcaagatgcacgatacccccaaagaggcacatcctccacccggacctttgttaatgacttctttaggtctagcaatggcaatgactgctgtctctaccagtaaagaagggatagcgttggtaggtgaagccgatcccacgtggggttcgactgctagagcatgctacggtggactaagattgtcaaaaccatccgatgtagacatagttgcgagacggtggcctttgccacgtttgtttggccgctacaatttctggaatcggccttctgctcgtttgacaaaatttggcctaacgagacgaaggaccacatatgtaaacgtttcgtaatgcgtttatgcgagcttcatcgcatggggtgatcccaatttccccgagttccccaactcttccacagccgtggtgcacccaatcggcttggatcaggggtcagcctccagattcaccacctggagacccctcggatggggatgtgatcactgcagatcaatagtgggttaactcacttcagttagcaaacgtcagccatcatccatagtcactcagcttaattagccagcgcctagctcgaaaccacagacccgctgatacgaatgtcaggaaacaaacatcccttccattttctgtaggatctcaatcttatgagtctttggagcttggaagacaagggaagaggcgaagggttggtctgatttccgattataggtgaccatggctttatgatcttgatctatcgaactgaatgccggggcaaggtgaacaggcatcgaggcccactgcattaccggcaatgtttacgcgtcccaaagccaagatactaagccagctagtggcagtcgcatattcactactctgtatcacgcagtgccattggggcaaaacgttgcctagtgtaccggggaagaattaggagaagcagccagcatagatggggaatgacgccaagcacctctctgctaatgggcggcaaggaattgccaatgtttcatcagtgattttcgaaggccgctactcaccgctaagctgaccggtcttgccactagtaaggtgatgcggtggcattctcattgcttgttcctctttcaagcctggcgtctttgagatttggctggatgtgccgactccaatggccaaccattgtctgaaggggacatcgaggtgttcaagcgagatgttttcttgcgcagaggccagttgccgccccgccccctacggtatcccctggatcgatcatccagtcatatcggcatcgtttgcggtgaggtctcagctccccggtgaacctgataggccatgatcgacaaaccatgccagtttgcaaggtccccgatggcgatcattatccgcctcgcatatcagaaatttcacgccattcatttggttaggtacccatgtcgataaattttcgtcttggcggcaggctgaggctaatcaagtggcacaagcccagggcacgtattatttcccctggtctcactgcatggtaatgactcgcaacatggctgatacgtgagagcttggcaggattagctgaagggtcagagaggggaagtctgtatatttgggtagtaaaatgcatgaactgtagcatcttaggatttcaacattgaggtggaagactgactatcgtgttaaggatatttattcattctggttcccgccttgattctacatgaacctagcacctagttacgtagagcagcagacgatacatcatagaaccatggcccatctcacaggcttgcctctcaaagcggcaagcactcctaggagtaggtacctgtgctcaatcaaactgagctgtccgtaatctcgcttgagagactcgcgatgcatctgcagcgcccacccggcctcgcttttgttcaccacctgcgccccttgacgcgaactgctggatgcatttctaacagcccggttgacatcggaatccagccccgggttacaacgatccggcgcactgcgtaaacgcttgtacgcatccgcaaattcaaagctgtacctagccctccagttggtgaactcctccatgctcaagaatgtctccagctcttcctcggtgagcaggcgagtgatttccgatgctgattgcgaattgcccttgctgtaacgagaaatacgccgctcagcgctctctattccatagaactcttttttggcttctttataactctcttgctcttttctcaacatttcttgaatgatcttctgaggggtttcgccctccaactccctgttgatctgaagcatcttgataaatggatttcgcagacccagccccccaagttgctcaggcaaatagaagaatgcatctggcaggctaaccacaccgaatctggtctcaatcatcttcctcagatggcatacaatactgcttctaccctctccttcattctctcggccctctgcaaacaagaattgctgcatcgattgatatgtttcaatgatactgttcacatgctcgccgccaaaacagtatgctggttggccaaagctgtcactgaagaagcgacccatgacactgttccaggtctggacccattgcagcacgctcttgcattcatccaactgtttcttgaactgtttcaagtgggcgtccacttggtcctggtttatcttccacttctcagtctcggggtctaggactaaatgcccaaatcgaacagctccctctggcagtattttgtgaatttcggcatcttttcccccttctttgaaatacaccgagccagttttcttctcgttgaactctaagcccagaatcccagccagatgtttgagagtcttccaggcacgagcgcaatgctcaggctcgccaacgaaccagaggtcatcgtgctggcggtagagaagcataccgtcttgctgattcactgcaacgtctagaatgaatagaacgagctccccgattagtttttcgggggcatgcgccattggcatcccgcgacgacgaattcgcgcacccttgccgttcggaaattctggcgagtgaacattcaagggagcctctagaaacttcttgaagaaggacacggccgcatcggtgaagccaaagaaacggaggacggcaagaattgttgagtgagacaaacccgcgccaaaccattgtagatcggtctgaaccatggcaacttcaccgcttagcgaacggtgaagcagcaactcagtagccaatgtctcaagcaatctttgtttcgtacttttagaatcttgatcgcccccattatctgaacgatcgtcatcgtcaccgtcgtcgtcatcgtacgctcctagaattgaatccacatcatgaggcaacgctgacaagaagaagtggtttctgtactgttccattcggacagcatcagcacttttcgtagggatcgctctgtaggcccccatgtagtacttgcgtcttgtctcctgaacagaatgaggctggggtccggtgtttgttttccatattgagttgctagaaaatacgagggtttcaagctcattcttgagaagaatacagagcgtggtgccaaaatagtaaataaaaatggcctgcaacacgtcttcatccatccagattctatattttccgtttagctgttgtcttggtagaacgggaactaaacaaaaatgcggttaatcgattgattaggaaaattaatccaaggaacggggtaggcttacttccatctgggccgacgttccaatcccaattctcgaagtcggagactctcatgttgaggacatccgcaatctcatccaacaccacatcgtcatcaagaaactctcgcagaatgacctgcttttcctcacttaatagatcttctttaagcaatcctttgatacaccacctcagcgtaacaaggtcaaatgcccggttatcgcgctcgaaaagggtcctgcatcgggctgcgactttttgtttcaattgctcgaaattctttgtcgctttttcattatggcctggttcgaatagatcttgaagatagagttcaatctccttctcgcctgtttcaagcggctcaaagaccacttgttcaaagtggtcacatagctcctgcaagcgctgcttctggcggtcgagtacctcaaacgagtcttccgcagctgctgtggcttgtccgtcatcagccgatgagtccatccactcggtcaccaagcgcgcatagaggtgccccaaacccagctttctggttggtacctcgagtttagagcgtaggctgtgctcatattggttgatgagctcttctggaactgagttgtcgtactttgcctggttcaaccagtgatgaatgttctgaatgctgtcgtctctctgatctgggcatattttgatcactccgtcgagcagtttcctgatccgtaacagttgatcggcgcaagaatctgcatcttgaagcaattgatttttttgagtttcgtatctctcgcgctgcttttccagctcccgaatttttgtcaacgtaatgctctgaagagtcttagagcgggctgaggttgatgaagccatgatgaacaaacggctttggagaaatatgcgcaagtatcaaatgtttggttgatggaaaatggagtggagtgtggtgtggaagatgatgaaggatgcgggaaacaaccgctgctcgaggtcgttctttacctaggtatttatgcttttaatctcacattgcctaagtttttttgaggattcacggggcatttgggtttggctgtcgtaggtagagtttgcctggctttcgaggtgaatggaacactgtggaactttactcggcgtttactattcaggcaaccttttagcgatgtaaatgtctttttacgccctgcaatcgtcaaccaatatccacaacaatgactgaatcactaacagggacaataaggcgtgttacgtgttggttgagccccgctcgctgctgcctgtttgcgaggaaatggacgattctagaaggacggtgagatgaacggtcccggtctccctctttccctctcatcccgccatctgaactattttcttgactagttttgctagttggaggcctaaatgctggcttgattctaatcaatcacgctgaagccatcactctggggagacgccactctctgggtccaagtataatatcaagttactggaaggagtcatgtcgggcgcagcctttttttcgcgctgaaccttgttgatgtcgggcaataggcgtcaatcttgatcgaggcgctcttgagtttgaagtggcgattgtgctgtgatgctgctgtactgtaaatgcgtcgactcttgcatgccctgactatttccattcgcttcttcatgcgtataacgtacaagttgagagatttcgaccaagttcccatcttcgagaaaatttgagttgaggatgccggggcaagacgactccgtctcggccgtgctgctttgcacagcagttcacgctattgggcagatcatcagtcatgagatgtatctcaactggaacaatgaaagcatgtgggatgacccaacttggcaaaacttcacagctaccttcaatgaggcaaccgcttcttagttcaatgaaagcttttccgattggactatcagcagcaatactctgactcttgataatgaaggcggcgcatcgaagagctattactggaacaccttgccaagagaattactatcctttacattcattgcaggactgatgtatctctgggatgtatggctggaggaccttctacctacgcgaccacgaggcgtcggagcagacgcgaaaaccgaaaaggcctttgacccaaatgagcctaaggaggagactctaggccgctcgatggtgaagtcaagcgctcgaagtgcatcaatcagctggcgcaacacgttcctgaagtggttgattgacattattttcggaacaatgtggaagagtgctgtctctctggtgatcggaggtgaggcactgacaattgactctttcttgatagtaagtactggcctttgatataaatatgacacatgaggattcggcctcaaggaaacaatctaaccataatatctctctcatataggaaacttccatcatcggggtaactgggttcatacacctcagttacattgtctctttcattgcgtttattgccgtacctgcaccgcaacgcccgctgtttaggaccggtgcggacgcgctggcttctatattgtgtacttctctatctaaactcgcgatggctcagtttttgaaattcacgtttgggcaaaggcgcatgatgcgagtgaccgagtccctgcggtcactcctaatggagcaggagaagactaaacaggcgcattttatagatgagttgtaaaactcagagaaaagacagaccaccttttatccaatttagataaacttggataggtaagcagtcatcagtttttagatataaaaagagtagttacaaagtgtctaggcctaggtaactagccgaggatggtacgctgtacatggaaggctttgaaaaggttcgcaagcgttgaatccttgcattgatagacgttctcaggtttgatagatacggtataccaaattactcaatcgtccagtcaccatttctcttcagactagagggaatcttgagtttctggcgcttcaactcctgctccatggtgaagtcctcaaacacatgaccaggcggcaagttggtgttctcaaacgtattcccagtttggatcgccgtcagagcatcccagtagtgatccgccgcgtattgttccggcagatgagaccacatccaacggccccagcggaccttgaagtcggggccacgcctgagagcttgcttgacgtcgacgccatctagatcgtcctggttgacaaatgcagtccgttgaatagtggtgacacgttggtacctatagttagaaagtgtgagagcttgctgatgtttgatggctggggcttggcacctacctaaggacattgtgcacctgtgttgaccagccaacattctccttaccgccttgtcggaggcattcggcaatagaaatggcatcctccatggcctggacggctccgttaccagaggtcgggaggaaggtatgagcagcgtcgccaagttggaccacgcgaccgccaggtgatgtccaatggcggtgcgggttgcgaaaattgaggctccagttgacgatcgatccaggggagtgcctgatgagtttaaggacggcgggatcccaaccgtcacccatcactgaaataacatcctcgggcgttagattagttgaagttccctccgaggaatcctctttctaaagcgcttcgttagttccaaataaaccaaatgtagtcgaaatccaacacttgccttgctgttaatcacccacgcaacatagtctttcgaagtagaaacaacgtgatgggaactcttgccgatatagacgcggttgatatctgcctcaccatctctaggaaacaggtgttggcactcggggcccaaatcagggagatctgatcgaggaaacccggtgcgggcagcaaagtatccagtacgttgcactggcggaacgttccctttgacaatctccctggaagccgagtgaacgccatctgcagcaataacgacatctgcctcatagcgctcgccatcctccgtctcagcgaatgctggaccgtccttgggagcctcgccatacttgacaactttcttgctccagacgatgggaatccccagctgcctgatttgagcgagcatcacttcggcatggtttggtcgagtgatgatctgtccgactgtgccgagtccactgttagcctcaacatcggaacccctccattcgggcatggcagagttgatgaactggccgtgatacgagtagtatgagatgggacagtcgtggaacttaaggggcatgttctccttcaagtaagggtatttttgtatggttgatagcgccgctgggttcagcccaacaacgtcaccgactatggacattttcggctctcgttcaagaacggtcacactgtggcctttccggtagcactcaagcgcggcgagcagtccgccaacaccggcaccgcagatgacaacattgatacgagttggagcatatctctcgatgccgttgcgttcgacagtaacacctgcgtcgtgtaaacccatagctgaagttttaggattcgggacttgattcgttcaagtttcagttgaaaagtgtgtgtttatagctgttgaacagacttttgtgtattggatgaagttgattttgttctcaactcactgtgtggcagggcggctatacctacttatagttcaaccttccaaggtgtccaagttgcattgtcacgagattgatgcactcagtggtccgcagactagccgcaacaccgcaacttccaaagccccgtttcgccggtgcatggtttctgcattgcataggttgggaatataatagttggcatggaattccaatattgaattccagagatcggcgtgacaggggcctaatctggactgatacaggggactgtctctaaataaccacaaatctagctccgtccgaagccctccttcggcgaatttatcaacctgtcactcttccccatcttaccattcgaccatgaaggatctggtccgcgtccatatcaatgacttcttggtatacatagcggaatttggcgtcgttatctgcaggcaatgccgacatgccatccagcccagcgccctggacagccacctcctgaggcaccggatctaccggcatcggcggcgagcgttggtcgagcgtctgaacaagcttgatctcagacacccggacgatgttcctgtcccaaatcgggcttggcagcttcccgagcttcccacgcaaataggacttcgttgtgacgccgacggctgtcggtatctctgtgcaacggacaagggtatgcagatgcactgggcatcgaggcatagtgtccataccaagagcaacgttcgagctagtaccgtagctctgcagactttcttccgtgggattaagctacgttactttgaggtcagtacgactccaggatcaaccccgtctgtggacacatctatacgcgcggcaaccatcggcggccgagagttggaagcggtcagaagctctcgtcagccgatccctccagggcttcagctcaactctgttgacgcgagagcaatgatgtatctacatcacttcacattgcatacagcgcccactctcgtcagaaagtgccagcctttgaaactatggcaagacgaagtgccacagctcgccttcgagtatcccttccttctccatgcccttctgggcctatccgcatatcatatctcaattaaaaacccaggaacaagccaggaacatcgacatgcggcagcacgttattcgtctctaggtgcgaccgagtacgcgaaacatctgctcgagcccaactacgataacaccacagcaattctagcttgtgccaattgccttacagtagagcaaaattcgagactcttctcggaccctgaagactccaacgagctagaatatgtagcctttttcctctccgggattctaactctcccacacgcccttgcgcaccttttaccaagaggctcgtactttatgcagtatgtttgcgagactcaggcgatcgtcgaagaagcaaatcatctgctcaagaacgacaagtacaacaatacctacctaccaaagtacatcccgccatcaaagtctcgctttctctcttccctgcctgatgaggttgcaaggctaagccggcattgtcccaagatactgagacagatacaacaaggacagttcacactacgtgctctcctgtactcgatagatcgtagctacgcttctgatgacttggcaaatctctatgattccgctgcctgctgggtccggtgtctggatgaacatgcgaagcaggctatccgcgacggagaggaattcttcctcatcatgtatgcctgttggtgtatcgcaatacaccggatcgggcaatacgcctggttcacacacgggattgctgagatccaaatcacagtcgtgcgagcccggctggcgcctgagtaccaagttctgactgacactttgctttccttgttgtaatacctctttcgttggagcgcaatattataggctgggaatcagtagacgccaactgagatagcatttatacaactagaaagaatacccttttggccagctacgaatctagcattacattatcaatgggcgtgctcgggtcttagatcttgaatggattactccattgtactacccatacgtataagtagaatgagcgagagaaaatagcaggcgatggcagagacaaatcgtgcaaatgtcgtgctgaacaggcttcggaccgtccccggaatggttgatcacctggtcaagccgtgggttggagagcggcaaggcacaagaatgccacccttcatacaagcatagcccctgagaatgagcacctatacctagaggggtttaatgcaaggaaccgaggacctactaatctcagtcatccgtggcctgggcgagacgaataggaagctgtcggtcttggtccggaaacccttgtgcaagcgagtctccgcagcggtccgatgtccgcaactactccaagccgcttcgggcaacaaaaccagacgtcctgggcaaatgacaatggctggtttataatgaaattgacgagtcggaatacgtctagagctgcaatcagcaccgtttcccgtttccggctttgtcaagagcaacgactgtcacgccaccatcatgagccccgtctcggaatctaacttgccacgggcacctcacaatgaacgcttatccatcctgcagggcccttcgcaaccagaattatgggaaaccaccgttggcgatctcgccgatgctcaggctgcaaagtatcctgaccgaattgccgtggtcagctcgtggcagtcggctcgtcttacttatcgagatctctccagtcgaagtaagcttgtcgcgagagcgattcttggagcaggatttcggcaggggaactgcataggcgttctttctggtaactcatatcagtaccttgagatctttctcggaggggctcgcattggctgccctgtggtaactttcaacaacacatactctccccaggaattgcaggctgcgatacgtcagagcggtacgccctatctcaaccccagatatgcagtgaggcacagagattgatccccgacgacttatttagattgcaagttactgttcatcgcccacactatcggtggcaggccgatgcgaaaatatgtcgaagacctactccaaacacagtcagagacgcttcttcaacgtatcaccatcattgggaaatctaaattttcgagcaataagaacggatttcgaatcagttcatatgaatcattcctcaaagaattggcacaagatgttgacgacaaggctttggcccaagcgcagcggaatgttcatccatccgacattttgaatcttcaatttacatcaggtaagtgccaaagcccaggcttacatttcttacatttgtcaagcagtatccccgttctgcttccagtgccgtagtatgctctactaacagggttgtgtttgtaggcacgacgggtctaccaaaagccgcttccctcacacatcggtgagaattccacttatactagatgccctagcttgaatagaactgacgcaactgacatcacactttccctagaaatttgatcaataatgccagatttacaggccattccatgctcttgacaccagacgatgtcgtttgctgccctccacccctcttccactgttttggcctagtcatgggcttcttgtcatcattctgctgcggcagcgttttggtgtttccatctgataatttcaacgctcttaaaactctcgacgctttggtaaaagagaaggccactgccttacttggagtcccgaccatgttcatcgcagaattggaagccttggaagaaacaggacaccgagtcaccaccgttcggacaggcttggctgccggctcacatgtggctccgtcgctgatggcccagctccgagagaagatgcaggtgaaaggaatgcttattgcctatggaatgacggaaaccagccctgtgacattcattaccttgctcaacgacacagaggacaggatgttccacagcattgggaagttattccctcacaccggcgctaagattgttgacaatgagggggaagttgtccccataggaatcaagggcgaaatctgcacgagcggatttgccttacagaaaggctactggaagaatgaggaaaagacgcgagaagtgatgaagtatgacgaagacggcgttttgtggatgcacaccggcgacgagggcttcatagatgcagatggatatggccacatcaccggcaggatcaaagacactatcattcgtggtgagttttctgttaactgggagccacttccgctttcaaacttccaatccagttcctcttccaaattatgaccatgtttctaatcttattcaaggtggcgagaacatttctccggaggaaattgaagactgtctacttgagcatcctgatattcgggaatgttgtgtcgttggacttgcggatcgaaagtacggtgaagttgtagggtgttttctaaggaagacccacgataacacaccaagcctacctgacgcagctgttcgtgcgtgggtagggaaacggctggggcgaatcaaggagcccaagcatattttctggcttggtgaacaaggcgtgggttcagatttgcctaaaacaggaagtggcaaatatcaaaaacacttgatccgttccaaggggaatgaactgttgaagaagtcaaccttggcgagagtgtggaagctttgaaaggccagtggatagcatagaatcatgtatacgttgattgggagagttgttgataagaaatagattcttcagaaataaatcatatgataggccactgaagttccagtaatcatcaggagtaatgtcaacatattatccaatcttccgatcttcccagaactgttccttggattttcagttagacagaaggccctttagaattatacaccgtatatcttcatcaatgcactaggatggagtgatcagtttgcgaatcacatagatgataacttatgtacaatgtagaacgctaagtcatttaatatcatatctttgtatgtatgatttaaagtggtaagactgatgattcttgaatgttaaagtgctcacgcgtcaaatcgtcattgtagtctgcacaaaatgatatttacgaagtcatagccgtcaaaattacttgcagctttcctttaaagtagaagaagcgtgcccttgtgcatgaagtttactgtgggagaactcattctgctcatcgtgtagacgataatgataattgaagcaaggctacgggactcggcaatgacctgttaattgatatactaatgagcttagtagaccgaactgtcatggatatagtgagttgctatcattctttcctaagaaaaggtttaatgaaagtttctgcttcttcagtttctgcgttgtgtgatcaacctttcttccaccaacggaatttcaataagtaagtcgtcataagagcccgctaagtacaccagctcaattcatccctcattcgtaataattccaactaatccttttggcatcgctgccaattatttcttaaacagctggggcaagaattatttgcgtgcgtccatcgatctttgccttgtaagttgcccttccagccttgtccgcagtgataaagtcgccagtgctgaggctgtatttgcggtgggggagtagcctgtcaaagccaagttcaaaaactccgggatcatttccgttgtagagaacaaggtcaagattgtttccatcgtggctgtacgccttggcaacaagaacgtctgggaaggatgcctcttccagcagaggtccttcaagcgcctccttgcttggcccatgaagagtggcattggccaagtctcggttccggactagacgggccatcagagcaatgtgctgcgacgtcgcagataagcccttgttatattgagcgcctgtcttggtagtctcgacagggaagtagacatggtcgagctgatccaatgcttcctggcggatcttttcgtcaccaaactcggctgcagcacccgctatgaaggctcggagggggccctcgccagcacgataacttccagggtccatcttgtctgcacccttgagattgaggacctgtagttggccgttcttgtcgtattttatgaactccttgcggatgattgcccaaatacgatgcgcaagatgaggtagatacgcagtgaggagcatggcgttgatgcaatcagtcagtgtaccacagagaccagggagctgataaacacgaaagatattagtctcgatatttcatgacgtattggggcgttaggacttaccgtgagaccagtgaattcgctgcgaatgggtaggattcttccatcacattctgtaaactcctcttcgagggacttctcaaaccggtttctcagcttgtggccgaggtcgcggccaagaatccgatccgaaataacaaggccagccattccagtaaggctatcaatttttgcattagacgtccatcatcttcatggtctagatcatcggggatgaaagaacatacttgcacagagaataagtccagttcggctcacaggggtagaggtagtatgggttatccgtcatgttctcgttgagggcatccgcaagaccctcgtagtttgttttgtaatgctttccgtcatcaacgacgaattccagcgcgttcttgtcgttgtaccgtctgtcgcctgatgcctgagcgtagagaccgatggcagagctgagatatccggtaaccatctttgcaagtcaatgtcagtatagtgaaaaatatggcgtgcgcatacagatgtaactcacgatattatcctttttgatggggtcgaaatcgctcagagtgaattttccaaagatggactcccacttccagtatctaagcaaaaagaggttaagaataaaactattataacgtaaagtatggaaggacttacgacatgatggtcttttgcaaactcttctcaatggcattttgcgaggccttggatagataaccgtggaatccaggagtatagtggcactggtacaggctcaaaacgtcaacaacgccgtaaagttgatagcgaacagcacccgtctggaactggtcaataacatcatggtagctgaaatcatcgcgagcactcagaccgcgctcaatcacatgctgcacatggcgcaaagtatccaaggaaagttctcgagagccgggaggaggggctggggcgccattctcgatctgttcctccacagctttcacaaggtacttgttgcgctcctgggccttcgaatatccggctgcattgagggagcgagcgttgctcataagccacatgattccgccgtagcagaagactgcccaaatcatggcggactgatcgaaaagcttgtcaccggccatgaaacccgcggcaatgctgctgccaaaccaaagggcaagagggaagaagatacctcccatcgcaaaccaaacaaagatggataccggaatgagcaccagggtgaccaagaaggtgaggacagatggaatggtggcaacagcagtaaacccagctccaggaaacagcagtcctagagcggctgccctataggcggtgctttgcacattatgaaacgtccacaggcctccgacggagagcgctatatactggtacaatgtgcggcgttggtggtatttcttggtgaggccgcgaccagcattgggaggaatgagaacatctatatcatagtcaccagtctgttaactccatctcccatttcgaatcaatcgatcaatataacatacctttgatagtccatggtccccagccaaagtcaccaacagtctcgttgctgtacttgctagtgtgtattagatacacggctcttgaccttggtaagggcaagtgaatcatcatcttcatgtgtgccattcgacacctggatggtcttagtgagctatgtttaaattcaaatccattagtatccgattctgagaggttagtggccatgggaccttggagttggttactcacagtaagcgacatagtgattgcgattttcaaggagcagcgatgattcgagtacttaggactctatcgaaactgtgaggtttagctgtcgcctaattttcacaaggtttattcgtaactttataatcatctattgctggcattcgagtgtattcggtccgcggcggatagctggcgatattcccaggctctgttgccacccgcctctcagaaaccacacagcttggaactcaatgcccgggggtgccaacggaatatgaggttacattagtgtgtggagtagtccggggaaatccactttacaaacatgtctagtcgaggtgctttgactgttcccacacttacgcgtccttgaaggatgtacatttccatggagggcggtgcggtgcggggaggttaggtccgtcgtgaacagactaatgacgacgccggtccgaactctagtgagctagctctactgttgccttgaaaacgttttagatgtcaacgatcccaattcgtggctggaggtttatcaggggccagtctctgccatcagtttctgcattgccattatctaccgtttatagtatcgaacaaaatgccacacaacacaagtactccacagtcttttacggaagccattgtctctcatcctcctgtcgatggagagcggcaatggaagcttgaagaaatcaagattgggaaacccgctgcatacgaggctgtcgtggagattgtagcatcgggaatttgccataccgatcttggctgtgggactgcaccggacggaactccagggtttccagttccaccttaccccagggtgctaggccatgaaggtacgtcccaaagagtcctatccttattctctatatttaacgtaaatcaggtgccggtatcgtgagagaagtcggctcccgcgtcagcaaagttaaggctggcgataaagtcctcttgtcctttgcattctgtacccaatgccacaattgccagtttggcgcacccggatactgttcccagttttctcccatcaactttacggggaataaggaagcctttacaacaatcaaggagggcaagccgattggtggatcattctttggtcaatcaagcttctcacgactgaccaaggtccaggaggtttccatggtcaaggttaataatctgattacaggtgatgaagagttcaaactattcgcacctctgggttgcgggatccaagtgggttgtttctgagaggctgccttctgttcgaggggcgattaattaacattctccattttgcagactggggctggtacggtaactcagctggcgaaagctacagccgacgacacaattgcagtcattggactcggtggagtcgggttatctgccatcatggtcagtacaacgatgccctgcttctatttgtggacattgttgatgagcgaaccacattaggctgcgaaactccaaggatgcaagaccattattggaatagatcgtgtgccagaacgtatcgaactagcaaagagcttgggtgctacccagggggtaaacaccgcccagatggccggctcattgacagaggaggtccgaaagctcaccaaagaagtcggtaccaccatcactatcgatgctactggggtggtacccttgatccagcaaggcgtggagttcaccgccaatcagggtcaagtgatcttactcggggtagcgccaatggacgcgggcctacaggttcaagtcgtcccttttatggtggtatgtctcatttccgggctaacctcttcttatgcgcatagcaagctaatagggatggcaaaacagactggcaaaaagctactcggtagtatggagggcggtgtctatcctgaagaggtaaagcaagtcccagtcttcgggggattgattgcatcgctaagttgattatcagtatataccccaaatgatccggtggtatcagtccggccgttttcctgttgacagacttgtcaagttttacaaagtaaggccacttattgacctttgatatggcggatgctaatcatttttcgtgagcaggttgaagactatcaacaggctattcgggatatggaagacggttctactatcaagcctgtgctgctgtggtaagatgtcgacaaaaatatcagggagtgaggcacaaatagccgggactagttggacctaatgttgattcaagtagctgaaacgaaatgaataagcaatttctttttgaaacacgggttttgtacataaattaaaaacaattctttcagggttatgtgagaagtccgtccttggtttattgtttacacatgagtaagtgtaattgagtttagggaaacgcacataacatggtataatctgatcgaggcgattggtcgaaataaaaaagatacaaaagctaataattatatactaattccggggtttgtacaagaattccagtactaggtctgtacaatacacccttgatttttgcatattggtggtagtcgttgatctgagtgtgtagggtagcctagcatcgtgtaccagaatcgttggatggagggaccgtgtgagaattttatttcacacagttcggtccgcctcacggaccgaacatgcattagcgctgtggctccgttgcggggaagttgcgcttctccaccagtacaaggaatatggttacgacttgcaccagcgtggcgggccaagaggccaatctatgcctcttcaagctataatatttgtgactgaggagctgtatgtcactaaaggccgttggtaaatgaccagaggtccgcttgatttgagtcatggtcgttgtaatgccctataattcttctccggcagcacagtccttggtcattgtagcaatggcacatatagttacgtgggaatactaaaaaatgctaaatgcaggaccttctattcaactagctgacgatttgcttgttacagaacaaggtctgtacattacagaaggccttgaggccattggctccccactcagtgccgatgccactctccttgtgcccgccaaatggggccatgggagagagatcaaagtgagtgttgatccatatgttgccagcttggatggacttgccaattcttgtcgctttcttgatatcgttgctccatacagaagctcctagtcccattgaagtgttgttcgcacgcgcaatgacttcttcctccgtcctccagctcaagagaggcacaataggacctgtagaataataagtaagtgatcaatccctacaaggaatgccgggtaataacacaccaaaaggctcctcgacaacaatccgtgaatcttcgtcgggcctgtcaatgatggtgggcgtgacaaaatatccttgagatggctcaatctttccaccagtggctaccttccatccttgcttctcgatatcatcgaagaaagtcttaacacgttcgtactgcatcgagttctgtagaggcccatgagtgacacctgccttcgaaccatcgccaacaacataatctttgacatgccgcacaaccgcatcccggaactcctcatatatagactcgtggacgtaaattctcttcaagttgagacaaatctgtaaaattatcgttgaggtaatgtccatatcacattaaacaagaataaccctacctgaccagagttcaagaatgcataaaaagcaaccttcaaagcagttagttatctggttcaagtcttacccgctgagatcttacctgttgggcaactttgtcaatgttaatatcagggaggatgatggcaggatcgttccctccactgagccagctgttagtattgtgatttaaaagtacttgatacttagaacttacagttctaggaccacgcgcttgagcgtcttactggcactttgaaggacaagcttgccggttgtcgtggagccggtaaagctaatcttgtcaataccaggatggctggtaatccatggaccaagcttatcatctccgctcagggactgcacaacgccaggagggaagaactgctgggcgagctccacaagcttgagcccaccgtagggggtgaatggactgtagttgggtcgtgttagcagccgtcgtttagtagagaacaaagcactgaagggaagaccttacgaaggcttcacaataatgacgttgcccgtcaacaaagcgggggcgatcttgcccgtggcaagcagcaggggaaagttccatggaacaatggccgcaacaacaccgagcggcagatatctagtggtgactgtatgcctctcgttgtcctcaatgacgtcttccggaagactaatatttgccatcccacgaatccattcgatggctgaatcagtctcgtaatctgcttgcggaagcttcgaaatagttaggtgaaaaagtaaccccatggcttgaaaagaaggaatctgcttactggctttccctgctctgcgacgagaagatcacgaaattgagtcctcaattgatcaatagcgtcggcgaatgctagaacggcactgcggcgttcctcataaggtacctgtgaccaggttttgaatgcctctttggcggaagacacggcacggtctaggtcttcctctgccgcgagcggaacatcagctttaggctgaagattggcagggttgacgccatgtctagtttgcttggtagggcttggtttgcctccgatgatatgaacaaatgaaccttcaaaatctaggttaggggtcggtcgctttgtctggtgcgtcagactcggggtagctgatggagccatgatgattcttcaggtggataaattaatgatggtgaaaattcttgcgtgcaaaacagacggtattgaagccttggaaatgcttttctgttgcctcaggactatgcacatggcgctggacaggttttaagaatggcccaggatcggaggaagacgacggtccgaagccgagcgctgtgtgaacaggcgcccagattcgcggtgccccgattcacaatgctagtctggcttgcggcggggtaaatgacatgctagataatcgtcagcaccccatcatgcggaatagtatggatcttgattggtgtgcgaatctcccctcatcgtaggttcccctcggcttgtcggggctgtgggacggcttggtgacggtccggacgcatatgtattcccgaagcattccagaccactattgcccacagtcagagttgtggaaggcatctctgagggagaattcgggaaatctctaatgcactggtcattgatgaaagtttatgtttgaaggcatcgataattttcaacacagtgttcgtacatagatacaaggttgacgaagtgttacctgactgagtgagaaggacagacattgttgttgatatgcgggatcatgatcttaaacccttctgatacgaagtctatgggctctaagttacttgcaccacaaagaatacaccgaggccataatggatgcctactgcaaagaagttaagcgattatactttcggaaatactattacttgcaaaaatgatctttctctgaaaagggagaagtcgtcatgtcccgtttttaaaaccttcctcgctattccagtatgtccattttaaaccaccctcccttgactgaatcaattggtagtcctcaatgccctgcgatatcttcgagcgtcacttgaagataatgggtcaagtattagtgcatggacctctgccccttgaacacggaggacaggtctccaaccggtaactggatcggaaagtccacaatttcaaacagaatagccactaacatgtaccatccagcaacacacgtaacgataagagatgccccagctccctttgatatgccattagtgtcaaatactaagaatagggaacaaagaccgagactgatcgcatcatagacaactcaccacaaacatttggtttgcctttgccgcgttcccttcaaagtcctctgcctgaagccagaatgcagctgtaatcatgctaaaggccggcagtagactgaggaatatggtgacaaagacaatgttcgttcttagcgcgcaaatcaggtagacaaaggccaggacccccatgactactagccagaaacctagcgaagcgaaggataagttattggctagttgaggggtaaactcccttcttggaactggacctttgtaacctacctagacttgcgttgaacttcgcattagctagtcctgtggttggtttctgcggatcggtggcgtagaaactgtaagccccgaagctggggttgagtatccctccaaatgagaaccaaaaaccaccaaagctacagaatacagtggctgggaagctgtttccgaggacccattcaaagatcccgctgagaaacatcaagaggccgcccataaaaaagtagaccgaactagaaatcatcagcttaaagtttcattatcgcacgcttggctgccgttgccatacatttgagcaacaccaaagtccccagcccctctccatcccatcagatcacacgcgagtggcataagagataagagaaacccgacgagagccctaggtgtcattactgttaagggccatgttaagaataggggtaatctgggattgacgggtggatcttgccgtacattggggttggattaccaaacgtgcgtctgaggttcccctcaaccttgttgggcggggagaggtagagcttttcgaaaagttcaggggtcatggttatgctctgtgcagagtgaagctccctgagtccttcggttttcccagactcaagatcgttggggttcacgccgtcggtgacgaattcattgtgtgtagcagacatgatgaaacaaactatggccaaattgttaggctagatgattgatagtttgagtcgatatgaaagagccaagacggatgtctttagatactgaggatataaaatgaatcaaaacgcagactcattgtatttgtgcctagaactcggctagacacggactgctaatgctcggcggaccgcccacgccaaaagagaagattcccacacagcatgaatagccactgtcaatttgaagatattaagttccatccaaccacggactggatctggcatttgcgggccttgtcattaccccaggttttggggtaagagatccaagggtggaggtgcgtggccataccccctgaccggtccgaagcggcagttgatgacgatgactgcgagctgacttgaaggtagtcgaaaagaggacatggcgtacgcggcagttgaaagaccaatcgaagtaggcctagcagcccttgcaggtgaattggtggttccgaacggtccgcacagtaacggtgggaggagttttgtatagctcctagctaactgctactccactttccgttgattaaatagactatataagacctcacaagatgcgtggagttttagaaaatatcatattggagtgttgattaggaaacatgttgaaaaattggatactagtcgtcatatggcgcaagaaatggtgccagcgcctaacaatgtaaaaatattcataccaaacaactaattaagatcatatcatgtattccaagttaggcatagagaatccagatggcatgaggtgatctgttccagtactaggatccataaaaccttcgatcggctcgatatcctcgtttaagtctatggttggaaaacaatttgcatcgtcatcgaagatagactgctgcaatggctttacacttgatttttgtcccgctaagctaccacacatgaggccatagtcgactattggccacaatacttcttccaacccggggttgaggtcggccgttgcatttgcgtccaagttgatggcagatgccacgtcacttgcatcaaacaataagagctgaatgtgctgttttacatagaagtcagtcatctaaaattgaattcgattgcgcaagtgggacaacagggggtaacaaaaagacatgaaggaaagagaatgagagcaacggaagtattaccattttagaagcatgttcccaaacacgccccatctcctcgagtatcatcaatgcctgttgattcttttcctggagttcagacgccatctgaatagtagactgttccccggatcggatggccatcatgatgatgctgcctgccacagtggtcgcgtacgcgtaaaaagaaggccggatgggaaagccagcggctgatgctttgtggacaagctcgatggcgttgcttgcgtgttcacagcttgtctgcagggaccgccgcagaaagttggggggaaccctgtagctcattttctgaactcgaaggcggagtaggatggggtgatttaggaggcagtagcataagtggaagacagcaaaagaaaacactacatgcgccgcatcctggtagtcgagagagccatctggcttcatgtgtgcctgagcaatatcgtcgacggatgtactctcgatgtgtaaatgatgactgacgaggagaaggtacgtgttgatggacgcgaactcggatctctgatcccaaggggccagctcatcagcgtcccgctggtgcaagacatatcgagcgcaccgtcctaaggccgacgcggccagtatggtcagagcaaagttgccgccaatccggtccgagtcggccgtccagttcgaaacttgatacaaggtcgccgttttctggaaggaaccttggcgaaatgcttcctcgtcgcaaggtaagctcacccggcagtcctcatcagcgatggctggcggccggctcctcccacaagacacgagcttgtcgagaagatatatagaccaaaaggttctcctacgctcctcctgctcgacaatggaaaatgtgctagagggttcttccatcaactccaggtcctgggcaatccgtacagagaggccaatcttgagccatcctgaactggttcgcccggctttttctccgccatccgagtcagtaaaaagtcgtcagttatgctatcaatggctggatactgacctgtgaaatcaatgatggctagtatattggtggtctgggccacatgcacattgggacagttctctgccgtcatatgatcattaagaacagagagccaagcttcgcgtgcataggcttccgtggcttgctgcttggcccatttgaaatatggattgtcggagaacctgagtgctgaagccaggacggcaaagatgaggcatttcggcaacaggccgtaggcgagcttttctcgaaagctctcctcttggaaatacgaatatggttggttgtaggcgtgttggaagtacgtgtcaattagtgattgcaccacggagtgtggtggcagtgtcgagaagcgcctgtggcgcgtcagagatgctcttttgatcctacgcacaagagaaacaccacgtacactgcatcgggggagcctaaatttggctcgggtttatacgtcgcgccctgcgataaacgacgccgaggggacaaggaagacgctcgccgaggacctggtaccacatttatgcttggattttcggaactgagggtcggtggagactgcgacattcggccaagggttacgaaattcatgctagaacgaagattcagggtcagaaggggtccttttagttgcaacagaaagcaggggagatgtttgtagcagaccttgagttggccgatccttggtcacttagcaaggccagctggctctcgatttgattgattctcttgagtagctcaggctaatgattgttagctgggtgatgctcgaacattatctgtctctgtgtgggattatggatgagctcacatgcaactccgcgctgggcaacttcgtcgaattgaatgccgtagcctgtgatgtgccagaggtcgaagaaggctgagtatgcgagtatggctcgtagtggcaattgcgaccgacgcgctggcaattcttgcatcttggtttctccccagagcattttgtcttgcgatggctggatgtgccccgtcgttagctacgcattggctaccaccaaacccagcacgcaattccagaactgtctgtcccattcgttgagatgaacatgacactgaggactcaacttaccgacaatgtgtgcaggcctgtcgtatgcgacggatggcccccgacatgctgcctctgcgggcggttgactcggtccattcgctggtaggcgaggccgcccttacatggacctcgccctgggggcttgtggccatcatgatgaccagacgagatcaatgatcccaacaagatctccgaagcaacaaattgataacttttcgtgccttgaacgaagagtgtgtagggagtgttcagtgtcctcggttcgaagtcgcggggaagaaagtggggtatgacttgattcatgttgcaaagttggagcttggatagccgtccaggttgaagttctaacctgagctggagagagccagtctcttacctaagcctctcgcgtagtatggcatggcatgggcgagcggatcatgtggaagtgggtgttgcttggggagaggcacttggctcagccaggcaaggtgtgacgacacatttgatggggaagcgaggctaaagaagacgaaggaaccatcgaaatcggggtaccccgtggggctgcgagcacaccaatctctggtgaacacgggagcaccgccccctcgaatggaggcatgcgctcgggcatgctgccatgagctagtccatagttgaatgtcattgtgctcaaggcaggcagacatctcccctcaagcccctcaaacgtggcaggccagactagtccaacatggaagggcatggcctcatatggcacccaaagcactgtgtggagactgcgtggggacggctaatcgaactccagacctccgtgcttccttcgaatgatgagattctagattctgcgtgtcatgtatgcccatggaagcagcggtccgccccacggaacgacccccgcacagaggtccccatgctgcctttgctaacgggctatgatccggtgtgcctgatcatggtatctagatacatattacgttgaagtggatttgtatacgtgggactatttcttgttatgcatcgaaatcttgtgaaactttatctcatctcacaatggcatgttgctatatcgctgcattttgtataggccagttgatcaaagcttgccatttcttggatgtcggcaatggtatcaagtacaacgaagagaaggaagaattggggatcgatttgccttcgaaaccgtcaaaaggaaaaacagagacagccccgagctctccatcgtcacttatcctgtcactcagggggctcacctgctccgcttgcatccaaatcgtcgaggatgcattggcagcagtttccggagtcagcaaagtcagggtttcattaacccttcagcaagcggttgtcattgccacagagaatacggcgctcgacgaggagctgatgctttgcgcggttcgcgacattggttatgaagcccaggctggacctagatctccccaaaagatgatcgagcaacttcaataccgagaatccacagatcgcctcggttccacattctctcacctagggcgttgtgctacgatccttcaggcgttgtcgctgttgatctaccttgtgccaggccggtttgctccatttcgaggtttgagatggtgtcttcacatggtatccatggctgtaatgctgtatgtgcagtttagcccagttgcctggatccataagcgtgggtggacgtggctgcgtggagggcgattgaatatgaatacgttgacttccctatccatgggtcttgcttcccttccaccgctgctagactggctagtcacgggtcggctcaactcgagctctttttaccccatggcgaccggcctcggtctcgtggtagttgctggcaagtatgtggacagtttgtcccgacgatctgcggctcaggatcttgttcgtgtatacaagcccatcctcgatgctgattctattacactatatccagaaatggaggtgagtaaagtcatttacgtgataatgaaaggggaaaataattgacttgatgttaatcattcagagagtgccggcttcatatctgaggagaggtgataaaatcgtggtggaacctcatacaaccattccatgcgattgctacgtcctagaaggttcttcgctcatcgggcaggcaattgtaacaggagaatctcttcctgcaaggaagaatgccggggactttcttctaggagggacgcggaacctcagcagtcgattagtttgcgccgttcagagagagaaaaacgactctttctacaccaagcttgtgcagagcgcagtagagtcaagctcgacatcctcaaacgaccatgagtttatcgataccattacgaggcactttgtcgcggttgtgatgggtctggccttcttcgcaccctgttacagtcagtatcctctcatcggcaaagtccctatgtaccagatcgtccatggttggatcacacatacaatcacaatactcacttgcgcgtgcccatgcgccatcagcttagcaattccctcagccgtagttgctgctataggtacgtaatgaaagttaccatctctttaccttgatacaaagtggtaacctaacctgccactcttagtcactgcatgtgggcagggaattatcatcaccggtggcataaacacacttcaaaagttggaaaagtcaaaaaccgtcgtctttgataagacaggcacacttactcatgcgaaactcgatgtcgaagatctcgaccttgtccaggagtgggagatggacaaagacatgatctgggaatatgtctgcaccatcgaaaaccaagcgatcgatgatcatccgattgccagggcaatcctcggtgctgggcttcgggaacttggtgttaagtgggcagaaaggcagggccttcgcaatactcgaaatgttgtatccgactcgggaaaaggagtcaagggcgaggttcaactagaaaaccaaccttggcgtcacattgctgttgggagccaccgatatttcaaagagatgaacatcaccgggacgccagagagtatcctagacggcacaaagggcaggattgttgtgcttttggcggtcgatgaaagatacgctgcctcattttttgtcgcggtaataaccagaaactctatccactcaagtgtggccaagctcacctaggtttaggatgctatcaaggaagacgcaccggatgtagtgaaacagttaatgcaggctggttaccagtgtggcatggtacgtgtttttgtcgacgcaaagtttacacaagtctccaacatgctaactttgcattactattgtagctcacaggagacacgcgagagtctgctgagcgtgtctcgcaacaactgagacttcccgtaatacaatccggggcactacccgacgagaagcaaaaacatatccaatccctccatgactctgacaaaatagtaacgatggtgaggcttatccatggcgatttgccggaattaacctaggaattaacaaaaagacaggtcggggatggtctcaacgatgctccctctctcgccgcagcaggtgttggcgtcggcctacagaaggactcaactacttccattgccggcggtgcagttgttatagtcaacactagactcggatccctcatcgaccttttcaagattgcgaggacgaccatggaccaagtccggttcaacctctactggatcttggcttacaatgtgtttacattaggcctagcgatgaaactcttcaaccctttcaatatttctttaactccgtatgtgaccctaaacccaaaaattattgtgtgagctacgctctctagatactgacagaaagaaaaccagttcccttgccgcgttacttatgtcattatcatcagtcttcttgaccatgcagagtttttggcttcggaagcgactagaaagaatcaccagaattcccggcaactagaattataagagtggagaactttccatctctcaaagaggcattgaggaacatatgcgcgattgatcatggtcggcgttacttagatgtttttttaatacaggaaataagagacacgcgagagctcattcaacactcatgcaacaaagatcatccgtgtcctatcatctagctctcacaaaagtcataatttaggtagtgacgtgattcgagcacggagcgacaaggcgtggaagactttccagaacatcccataattaaccccctcttcatggccacagaacacgtgagagagttcgattataaagttaaatacagcaatgaaagatgctagagccgacatctcgacacaatgaatagaaggccacagaacacccatagccctaaaaatgtgacatccagtgattattcaactatcaaggaagtctacatcaagttttcaaaattatgaaatgcatcaagcgggccagccatccaccgctcagtaattcgtcgcctgggagacaatccctcaacgtcggccatattgcacgtagatgcagcttgtgatgttgtccactgactgatatcaaactcccaggagataggttcagggatagtttctgggagtctaccagttttctctgagtgtccttcttcaacttggctccaatgactagcgctaggagacagaggagatggccgaaagtgtcgtggctgactcggaacaaagtaggcctcctgcatcaattcaatgacgcgcgcacactgattgtgtttggcctgagctactatatcaagtttatttagccgctcaaggtggacttcggaagcagatattgcgaactgcatcgctccgggatggagacagagctccagaccgttggcttcaatgttccccataatgtgtgaaatacgccctgcagcatcattcatcaacacctcacaagcttccgtctcataggatgttccgatgtcctgctctgatgagagtccaagccgtgattggtacgcgtcgagcatcgccatgctgaacgccagatgaagaaatgaacgattgactgctactgctacatttccctttcttcccaaatcatcttgaattatagggcggtatcgtgctctcaatggcaaggcactataccattcagagagacgatgtttaagccgtcggaatggccaattggcgttggataatcccccaatggcccaatctaggccttgccaggtgtagggcgagttgcgaggaaagctatcatttccatccaggagcctacagagacgggtttgctcaacgaataacagcgccaggtccaaatatccttgatcactcccgttacaagaacatactgtactgtgagccgtagcatcactgcgctcatgccgaaatggttcaaaatcaggaatatccggcattgaaacattgaaatcgctctctgatatcatccagtttcggcctgttcccaagctgactagacggtccagattataacagcaccaccataagcgtcggcggattctcaaggtctgtataggtagtgctgacccgagcgtattcgggtcgtaatgaagcttgttggcgaaagcctgggagatggctgcgtcgagccaataaaagctgcttcgacgcccggctggctcttcgtaagccagagacatgagcagcaagacttgtacactgatttgctgatcgagttcgcagtcgaagtcataaagtagctatgttacgttagcgggcccgtccttaagatttgtaactctgagaagcatctgacctaccctcactttctccgagaatatcttgcgagcgctctttcttgtttgaaaccgcgcttgtttgaggtattcgatccttacacaggctgttccagccgcaagaatggcctggtagaggagcaaactgactcggggtgcaacgtgatcagttgccgtgatgcattccagaaagtgagaaagatcaataaccgggatatgcgggtaaatgttgtccacgtatgcgcgcacaagggccaactgaagagcctggctcgggagggacaaggctcctttcgatattaagaagtccaggtcatccgcattgataccttgatgcagtggcctgatgaaccatggcaacgacataaccgtcgataaagggtccaagatggagacttgatccaagcgccattgttttggcatatattctttgtttggtttcgagcatgatccgggttttgtggccactgccaagtttgaatcaggactgtgagaactcaagctttgcgagcatggagaatctgcttctgaatgatcgtcctcgcgcggaggctgctcccactgctcgtcttctgccacgttataaagatcgtaaaggcggaatgtactacttctaaacttccagtcaataatgccatcttgtactgatagacaaggtaggatactttaatgatatcgaaattggcgatacatacttgcgtgggcggcggtccctcacgatgcaggctcgatcactccattggcagttaccacacggccatcttcgtgtcacatcacatcggactttccgagatctgcatcccagacaagctcggggtgctcttcctgacaccggtttagtcaatggtccagtgtgatgacgatcaggctttgaagctagagttgaaggttgtgatgtggaaagtacaagactggggctgggacagttgaaacccaaggattttggtgttgggagagcacagctctcaatctcagcaaggcagccactgcttggagtgatatggtcgggacagtcgttcgtcatatcgacagcactctacaaaggctctctttagatacaggcgcaggcatggaaaccgcctgaatcgaggctgttgaaccaaagatggccttctattgatatactggtgagacacggtaaactccggagttgctcccgagcttggacgttagaccaatgcggcatagctattacatcgcctaacacattttttgcgggattgaataaggatatggaaccccacatcttactaaatggcaacaaggaacggtaggcaaagtactacccgtgggtcatagtttcgttcttcgctcgtgcgttgctgagaagatacggtccgatcggaccgacgccagggatcgaggccagatgttcgtcattcaacgacagatgagtagggatggcattgatcagtgaagggtaatttttacacttcaaatttgttgcgagagcacttcgggtaaggcaactgaagttacaagatttacacatcacgcacaatcccccatgatcctaacaagggagaacatgaggactattttagagataaattactctccatagattgttcttactatatataattgattctatgcactgttggtcgatccttgattacattgagggcttttaccttcatcttaagatttacaatgtcgaggagcctaagacagccgagaccgcaacatgccatagaactatcaagaaaccattctacaaactacccatctcaagaacacagcgacgttgtggtgcagatcgtacagtacactctacactacccggcaaagcactttctcttctgctactgcatcaccaaccttccatggtgtctcaaagcggccgtccacactagctttcaagctcacttccattttcatactctcaattaccatgatgatttccccttttctgacctcttcgccttgagacttcgggatagacagcactttgcatggcattggagctttgatatgtccctgcgtagcgctctgatcttctgccgaggtacgatatccttccatgtatgagagcagggtgtccttttgaaaccgtacgaacgtcccaagaattggaaagtggcagagaatatacctcgattgtccctttgcttgctcactactctctgacgctttaggctcgatgcaatatgccaccactttggttccgtcaagtgacacttccaagatacctggactagggccctggccagctggactaggggagttccagttcaaaaccttaacagttattggttgagggaattcggaagacgcttgtcggacatggttgctgattcgattatactgaatcgccatctgcttcgtgctcgaagtggtagtggcaatggtttctactgccttcaagtctctctgcgacgctgagttgaggatgtgggcaaaaggtatcactgccgcctcgtattctttcgcctgggcactgttatgtgccgccatcttccaaagtgacaaactcgattgaggcgctggggcgtctgtggaggcccccaaaccttgccaatccgtggttacaatatcacactgaatacttccagggtcgaagcgctgattgcggaaatgggaacgcacattctgaaacggccgctcattgtgagaacctctttctttcccactaacatggagtcttatgaacagggacggaatgacgatgagttcttctctaaaacgttgttgcttctcggtgagggaaggacgaagaagctgatctagattttgtgggatgaaggatgtgttgtacctcaggtctcggaacttggggtggagcagacaccgttggaggaagagctggtttgttctcacacccatacagagtgtgttggccaaaaggtcagccatcttttgtacggcgaggtctctcgtcggagcccatacaaccagtttggcaatcatggagtcgaagtagatcgatattggggagcctgactggattgccgtctcatacctgacgtctctgcttgggcccagcagtccccccgctggtttccagagagagatcaggccgttctcggggaagaagtccttttcaggacactctgcacacaatctgcactctatcgcgtggccgctttgcgtgagttgcctcgtagctgagagcgagcccaagtctcctccgcatgcaacgtagagctggactgacacaaggtctactcctgtaacctcttccgtgattggatgctccacttgcagccttgtgttgacctcgagaaagaaatactgagatgtttcaacatcgactacaaactcgacggtgccggcgttctcatacccgatcaacttggcaatacgggtcgccgtttgccccatgctcgagcgaagcttgtcactcaagaagagacaggggctctcttcaatgactttttgatgccgacgctgcacagagcagtctctctcgaaaaaactcaggacattcccatgcttgtcaccgacaatctgtatctccacgtgcttgctgctctcaatgtacttctccaatatgacgtcggtcgatccgaaagacctcgccgcctcagactgaacccttgcgagttcctcgctgagctgcgatgcttggcgaacgattctcatccccttgcctcctccccccgccgaggccttgagcatgattggatatccaatgtctccggccgccttctcgagatcatggatctgcgtgctagagcccgagaatcccgggatcaagggcacatccgacgctttggcactgaggtattgcttagagctccgcttgtcgcccagtgttgacatcgcaccagcactcggtccgatgaatatgagcccagcttttccgactcgctcagcaaaatcggcgttctcgctcagatagccatatcctggatgaatggcttgcgcgccggagtccaatgccgtcttgatgagcagctcgacgttgaggaaaggattagtcgtgtggctctccatactccccagtagtatcgcttcatccgcctcggacacgtgtctggacatttcatctctatagcggcgtgttagtcaaactatcgctgttcaggaattgcgaatgctctcactctgtgacgtagatgaccacggtgcgaatctggagctttctgcaggtggatatgacacggcaggcaatttctcctcggttggcaataaaaagcttccgtatataaggagcaccggtatcaggatcgagtgggataggtgccaccgcaataggtggtcgttgtgagagggcctgtccatcctgtgtgtggtccatttccgctcaagtctatgtaaggtcaacaaactccgagtctctatgaatagcgaaatacaaggagatctaagcaatttgaagaaagtgatattatccgaaatattcttaataggtttgcagtagtgccgatgccttccaagtggcatggcagggtttcttgatttgttccgcggagccaaagacccgcatcggtccgctacaaccagcctcaaccgagccggaccgggcagcggcacattctccagacatgatacttggggtcgagttcttactattaatttcgggccatgagccgtgaccgatcttcttctgtggtggaagagcgtcagatttcaactgttgggccaggcttcatcctctcacaactacccccgggacttgcacacgagcgaaaataacaataaaagtgttcagtttttgacggtgacttcttggagaatatttaatcacttaggatattaaatgaaataaatcatgtatacgacaattttgaagctcatttctggatttagatctgattcttaataataagaagtaattatacatataacagcccatagctcaatccaaacaagggaagcttttcgcgactttgacaatttagatccgtgccaaaaaccgactcccatgcgcacgagaatcatttgtcgagccgacaatctccaaacacatacccaagatgtcacgagtatcacgagggtcgataatgccgtcatcaatgagcatgccacttgtcgcatagctctcagaatctttccgtgcctgggttttgaaagcgttcactttctcgtttgtctgctcttcaatcaaggatttgcctcgctcaatctgttccatgacaccggcgagctgatcaggccccatcacgccgcacttcccaattggccaggtgaacagaaatcgaggcttgtatgacctgccgcacatggcgtaattgccagcgccgtaagacgcaccgaggatgatggaaatgtgagggacctgcgagcaggatacagctgagacgagctgtgcgccgaatttgatgatgctggagtgttcggctttagtaccaaccatgaagcccgtcacgttgtgcaggaagatgatgggagtttgcctagacgaatacaagttagaagaagagcagagtggaagacattttcaacaacggactcttgattgcacagacgaatgaactgtgccgctttggtcgcttcattggcatttatgattgaaatctgatttgccacaatcccaacacgtatccctgttgagatatgagcacttttttttcattaagttctgtggttgaaatgttttacaaacccataatgtgagcccagcaggtcagcatatttatgccatatttaggcttgaagatggacagcctcgactcgtctacgaaacgaaggacaacttccttcatgtcgaaaggctttcgtatgtcggggttgactagagaaaggacatcttcaatgggatatcgtggagccaaggggtctttgaggcgaagcgggccgggtcgaggcttgagagtgcttgcccattctcgtgccttctggattgcatcaaacctgcgactctcggtcagctgagcaacaaggacccttggataacgatccctactcgtcggttgctatctggtcagcaagaccagtaagtgtggcatgcacgtgtgcaccacccaactcttcggcattgaccacctctccggtggccatcttcaccaacggcgggcctccgagaaacgcctgagcttgcttctctacaaagatggtataatcagacagcgcaggatggtacgctcctccagctgtcgaggacccgaatacaacggcacatgacggtttaccattcaacgttcgtactgcaagatcatgaaaaagctgaccgcctttatggaagacgcggaactgctgcggaaggaatacacctgcctagatgaaagatgagcacgacgttcgatcagtcagaattaagaacgcggggaggcttacggactgaaccaaggatatcaaaggaagatcgttatcggatgcgatctcaagtatgcgatttactttgagaactgtccaagcggtttagtgggtaatgctagcaatgtgccgttgttgctgcctcacctgtcatctcattccacgctccacccttttgtgttggtatgtgggacatgatcaaacaacgttgcccgctgcattctgtcagccacgaggtagatgtccttgcttggaacacctggacactgatacatacctcacactgcctacaccagcgatcaagttggcgcaaggcgtggagtcggcatttccgaacccggcaaaagcacatagctccaggaaaggcgaatcgtcgtctaagagtagggagatccgatcgcgggctgcgtagataagcagttagtttccctctgactcaatattgtcttgcccccggcgtcgacaaaggatcccagattactaacgaagaagttggcccctgccctggtgccggtcaatcgagctttgattgccttcatcactaacagctttgagggcgttgtctagtttttccagcaccggctcccaattgtttttgttctcttgaaattcagtttcacgaagatccaatttcgcttgttggactgggaaggagttcgacatggtgtttgtaggagaggtacagctggtgacgcgtgggtaaagggaggttggtgtttcagagaaattctcgtaaacaaacgtatgtggtacggaaatatcagagatctgtctgaattgacctcgggcccagcagttaccgttaatttggttggacggttgctggccgtgaatcgcggaggttcggcatcggtccgtcaagatccacctcggtccgtgtacaaaagattgctgcatttgggggccaaccatgtccatttgatgtgcagagcagacaaggtaaatttagcaaccccaacagcaaatcaaagaaaattgcctgtcttggcgaattaccaaagcattcatctctctatagatgcgttgcgcttgttgccgaccattcaaatggacccgaaagtaaccatcgtcgaagttggcccccgcgacgggctgcaaaacatcaaaaaccgggtatctacagaggtaaaaactgagctcatacgaaggctctacgactctggtctgcggaccatagaagtcacgtcggttgtctctcccaaggctgtcccacagctgaaagattgccatgaggtccttcaaagcaaaaccatcaagcaactagcccaggcccattccgttcggctaccagtcctagtcccaaacatcaaaggcgctaagattgcgcatgagtatggtgtctccgaggttgcagtctttctcagcgcttctgaaggtttcagcagagccaacatcaactgcaccgtagaccagggaatcgcaagagctcgagaagtcgcttcagaagccaagaaacttggaatgatcgtcagagggtaggtattttattcaggaactccagaaacgagacatgctaatgatgtgcaaaagatacgtttcctgtatattcgctgatcctttcgacggaccgactccggaatctgccgttctgagagccgtgaaagagctgttgagcatgggctgttaccaagtcagtcttggcgacacactcggagttggatcaccattcgatgttcgtaaacttatccaggccctcaacgagaatgacgttcccctcggtcagttggccggtcatttccacgacacctacggccaagcgcttgcaaacgtttgggaagcatatcaatgcggtatccgagtatttgatagcagtgtcgctggcctcgggggatgtccctttgcgccaggagctacagggaacgttgcgactgaagatttggtctacatgtttaaccgcgcccgcgttgcgactgatgttgatttgcaaaaactagtcgaaacagggcgatggatatgcagcaaactggacattccaacagcaagccgtgcttcagcagcaatgtcagccaaaatccaaaaggcccaagtttcacgacccggtcatagcaccaataatcgtgcgatcgacttggagtggaaagaggcatcaaagtcggcaggtttaataacacatcgatctggtgccaacctcagaatcaccatgaaccgtccgacgaatggcaatgcattgaccaccaagatgattgaggacctagtctcaatcttctcttcatcagccaaagacccgacaattagtcgaattgctattatcggaaatggtaaatttttctgcaccggcatggatctcggcaaaagcaccacgccggttggcactgacgaaacctcggccaacgagcagtacgaaagacttcaccgtctttttgagacgattgaccagtcccccaaagttactatagcctgtctgaatggtcctgctttcggcgggggcgtggggttagcattcgcttgtgatctccggcttgccacaacggacgccagcattatgttgagcgaggcaaggctgggactcagccccgcgaccatttccaaatatgtagttcgagaattcggcgtgccgtttgctagggaggcgatgttatctgctcgacgtatccctgccaaggagctggagaccagaggtatcatcaaggccgttgcaagcgacatagctcagttacagtcagccctggacacccttgtcacagaactgagatttgtttcctcggatgctttgaagatgtgcaaggagcttgtacatgtgagctggatccatgggggacaagagactcaggagacgaccatcaagcatatatttgagcaaatgatgaagcctgatagcgcagggtcttatggagtaaaagaattccaagcgggacgaaaggtagactgggacttgtatcaaagaggtaaagctcaaagcaagttatagatggggcttatttcctcttgagacctttatgtcttgagaggactggggcagtggaggttcgagtacgttgagatacagtagaagacagctggaaaggtgccaaacccaacacctcgacacaataagtattggtacatggatatgacagacttctatgcatatatgctcttgtggactgattaacttttcagaagcatttaagcttatccatgctcttgcaacactactaattaggcctaactattccattggaagcattgaacaaaatcaatctggtcctcatattttcaagcccctaaatacagagtcccagggccgtcgaaataaggtatgcgctcttcaccgctacctgaaaagaaaacgatcctgtcaaatagtagcaactgagtactgtgctaaaatagtgtttataagtgttcaacttctagttttcctggataccaaaaggatcaacatttgggtcgaggtgccgattatattccatccatacggcaatgtcctgtgcaattttgccaccgtaaatagcttcaacaaaagcaaacacaagatcaatgcccgaggatactccagaagaagtccaaatgtttccatccacgacccatcgagcgctcggcacccaattaacctgagggcgccatggcggaataaccttccaggctcccttgtacccagttgccttcttgccatccagcaaaccagtcaaagaggtgattccagagccagtgcagacagtaagcagatactggagcttagggtattggctgaggatgaattgaatcactagattgagaatcgttagattaggcttgccggcgtcatttgggtcgaagcagcccatcccgcccggaatgataagcacatcaaactgcggagcagtctcaaaggtgtggtcgggtatgagaacctgagaagtcgcaaatggcttcattcccatattttctgggaaacatttaggagaagtcgcttgaggctgtagagtctcggcaacaagggacaatgagatgccgtcaacatgagttgaaagaagatttaggacgtcaagagggcctgctacatcaagcaactgaaagccttcgtaaaggaccattccatatttcttgggtgtgacagccatgttgaatatgagaagaatacgcgacaagttgatgcgaattgtatgcttcaaatggccattctgggtacgttctcaaaagaatcctttagacattgaaaacaaatccagtacatgaataaaaagtactatgggtgaatgacagtatgatataggaaatcaactttaccccagcttctagaatctcgattgccaacgcgtatatctccctaatctctcccgcatccctaagcccgtcattgatctcctggaaaggtgttttctttgcggacccgcatcacgcgaacacttgaaagatagttgcacctgcctatattcttcagattttcgtttcatcgagcggagccgcgacggagccgcaactactcggcgaaatggagttcctcaggtgcatcactagtttcatcgtcaatgcctgggggagcatacatggaatcgagactagtatgcatcctggcgagtgtcttattcggctagtgcgtgggaccatgttgttgaattgcagtcacggtggtaacaagcataacgcgtgagcttgacagacctgttcacaaaggactaaaatcaaaaaccgcaaagagctgcttatatctaagtatatgaaaattgattcaactttctatttgatacttaaggatagatcagtctaatctcccatttgtcaatgccctaagccgcctcctcctctgcgggaaagtccacgagaatagcacaatgagaatagatggtttcggcgctggcttgatttccgtactacatctcttgttagccccgctcgtagttcttcaaaatggaacactgcttaccgccgcatatgcaatctgcagctctgactgagacgctggtgttgtgagccattgtgtcttctcgcccaagtagcggccccacgacgtgaatatttcgttcagacgtagaccttctggtagttcctggtaatattgttcgatgaacacaccgaattccttgccagccacttgtttcgttggaaccgctaactcccaaagtttgtgggcttcaacgtcggatttataaggctcaagatctgcccaattctccaaccaatgccactggtcatctaattcaatgacggctgatacagtggggttgagatttagtttctgaaatacttcccaaattgctgcatcaacgcccttaagggtatccgggagcggcgtctcgatcgggtcgttgaatgcgtaagcgtgggagcaccagaaccccaatgtgccgcctatcatgggagttagtcttcgcaaccggctactcatttctatgaccgatctcgtgcccataggagaaactcaccttttccgccgaaagggtcctcgctcagggtatttgacacagcttggtaaagtggcagatgtgtaatatcaagtgtctgagacacgccagttaagcgtcctgtaccacgcactgcgtacagattatatgtcaaggtgaggcgatgaccacttgtgacctcgagaatctcatgttcacagtcgctgtagaacgccgcccaacgaatggtcgcaaagtcgggcttcgtagagctagtactccagtcgtacgtaatctctctaccctcgtgacgaaccttgagctggccaccttcgtgctcaagaggcaggcaaacaaccagggatccaaactgtgatggagatcgtggcgtgtcgacgtgtttcttgaattttcctgatgggctggtgtagagctagaagccgtgttaaccgtattcaacaacttctcgccactgaaattaagatgccaacatacattaagtttataaagctcagctcgtacagatcggtgggtggatgaatcaacaatactcggtaggagaacctgagcaattgtgtcaacaataccaagtgaataagggtcaaatgtcgaacagaatgcggtcgtgtccattttaagagccttgcgatatgtctcgtcatagacatcctcgcgtccacgaccaaaagtggctggctgggtgccatccaagagcctctgaatgtcattctcagatcccggagcaagtggaagggcgatcttgtcgcatgggttaccgcgctgcgctgtctctccgtctgtgccagcaacgtcccagcgaatagtgataggctcagaagttctgggctcatcgacagtaggcggattgctcggccgaccccgggtgggagccctgcgtggttgagtagtttctggtctttcaacaattgggatagatccgccacaagtgaacaggtggttttggttcgccaggaaagccctgagttgatccagaggaggtttctctggagggggttgttcggaagggggagcggtatcttcagcagcttcgtttgctggctctactggcttggccttttggcgaggcttaaaaaggagtctggcgaccggtttgtcgcctcggtcacttgagtcggccatctaattattaaacgttttgagtcttgataagctagttgtttcgcgttaagtgggggattgtcgagtggaaatcagaagggattcacgcatttatataaaaaaaagacacttaggttttatctctgagcgcgaatgcacagttgcgtgaatttttgaacggaaatatgtatagacacagtccaatcccgcttacttctcgttgtgagggttaatgcacaccgctccctccccctgtatgtaagacttattcgcggaagaatacgcttacaatcatagttattgacccacgagtatctatggtaccctctaaatctaagttgtctattgtatactctacactttgatatgagggccatgcatttagtgcaggaataataccaaatctagcatcctcaaccgtcaactagtgtaaccagttaatccaatggcaaaggactgtttctttgttggaatcttattagcctgatgactcaattgcctcagacctctcccccatctcacatttctgcgtcttcagagcaatgcaaaatttagatcttgctctaatacgttcgcctttccagatgaatacaaatggaatgaggcacatgataccgctcaggccgcccaagagagtacaggcgcccgcgatgcccagcctctcgatcattggcaaagtagcaagtggaaggaccaccgcaagaagagatcttgagccactggatgccgcgttagcgctggcagagtagatttcgtaggcatcggtgaaatagctgagcatcgctatgaagatgagcgtgaagccacacccaaacggaatgccggcgagcagcggcaggacaaaggatatatctgtgcgagcgctccacccgagccagaagaatgaagttgcaaacattgggcctccagcaactgcaagaggaaaacggtaattctcttggttttttgtccatgggtcccctctggccttcgaggttgagaggtaaccattccatgaaaaggccattggtaacgccaagatacacccagccccaactgacaagaagcatagaccagttactcccgggctcaatccatacagatcccgaaatataagcggaaaggcctgaaaagtcatgtacaatataacatagcacaatgccaaatatgcgcatgtgctagacacgatgagctccgaaacaagcatattgattggtctcgtgaggacgcgggtaacaagctgctttaaatcgcgaggctctagctctgccactgaaaatatttgggctgtgggatcggcctcacgaattttcttggctcgccgagtcagaagagcaggtccaaaagtctcagggacccagagaattgctggtaggcaagcgcccccaaagataagagcgatccaaaataccctgtgagaagtcagtcaacttctgtgtctcgcctgcatcgccagctactaaaagaatgtaatactcgtaatagagttgagggcttataaggaatatctttacctaccatcgccagccgattgtcgtggaacaataccctgagatcacaggagcaagcaaaggcccaaaaagatttggctatcaaatatcggcgtcttagttttggctattatttaaccgaagtcatgatattcttaccaacataaacagagccattgaagttcccgttctcttgggtcattgtagatatcacacatgatacctacggtaacagcaatcggagcaccaccaactgcaccagcgaggaaaagaaacatgagtaattagggccaattagaagccagaggagcggccatagtccatatcaagaaaaggacaaaggtcggtatagttatgttaacaccctatgtcttcgctcaatggccccccctgctacaattagcggtaaagaaaggtatagtagagaagtggtatatactcacagatgattggcccaagcacgtatccgatcagatagactgagataggtaagatagcttgctcctgagatgtggcactccattcgtggacaatgtaaggaatcgcgttactggggaacgagcttcccatcgtactattgacaagaaggcatatggctgaaaccaatgtcgccgaccaagtcgttcaaaacgctacctagtgaatggcagcaacccatacgagcaatcacatgctcaagcctatgctagctaactgtaaattttcatatcgaaccgttgaatgaaacaacggggccggttaccaccttggtggtaattctttcggagacaccacatcctcgggttccaaacacactcgtaaccatgggttcttggtaaagttactagaaataaagagccgcaacgcgacgatgcaacaccaggggccgccctagcttaaaacatgaacaacactttttggtaggcaaggtagggctaggaattcgacccttgagtagttccattttcaatgatccaccaaacatgttgacttctttttcttccctagggagaagcaggaccaatggtaaaagcaagggcaatgtccacaacataggcagaaaatgttgcacattgacatggagattttcacaaaggttagcctggaatgacatgtcaattcctattctcttctatctgacaagcaagcggtaagacgaggccgggcaaaggaatcaaccctgccatttggtcgcctgagagccccgatgtgacacaatgggctatgattaaccctgactagcccatacaggctctcacaccgaatccttgcaagccacggtgagaactattatgtcaccagggagtgcaatgccacaactatcctggcttctgaagcgaaggatgtgctagcaagggtcagcacccgctccgctagcctatgggagcaatagcagaacagcagaaagccataatgtatctcacaggggagaaagtccttgtgcacgagcgtgttccaaaattagacattcaaaaaggcagcctcacttcttgaagattcatgagaatgatcggtgaaagtttctatcaccaacattgtgaacgatccccagcagtccctatgtaacaagggacttgggaaataacatgcgcgaaggctacgtgaagctggaccttgcagtgtctattccgacatttgtcggttcttcgctctcgtttcttgccgcgtcaacagttcttttgctgcaattaatttacccgcctggtcgacattttcgccacgcgctcatcgtcaatcttcttatctcaggtgagcgctccctgcaaacaaagagggaaaagccaaccagggttgttttatactgatcttccttagatttgatgaatggtctaggcaacacaatctcaggggcctactttctctcgcaaggcagcactccagctacgaatgccaaccccagcgctgcctgtatggtaaacgcttgggtcaaccagctgagcgtccagaccattgattttaatattctcaccatttccgtcattgttctcatatcagtagtgagaacgcactggatatcaaacttatcaacgcgggctcaaatatttttctgtgccggcgcctggattccaggtttaataaccagtacgtttggcgctcttccagtcgtgacctaagctcgacggggggcaagatgagtcgcaactaactcttcttcctaggcaatgttgctctcggcttaaatagctacggtttcgtcagcgggaattggtgctggatacgaacggatcgtctcgatcttcgctacggtctcacacacggatggcggcttgctatcttcttcgccacgatagccatctacacgtgcatatacgtgcaaatcaaacgcatttatggaaaggtcagggctattggaggcaccttcgatatctcaatcgaaagccaaacccgggatgccgaacttgggcttccatacacacctgattcgcatcagattctgccctcgggcccggcatctctgtcccaagagaacggaaaccagcaacacgtcaactctagaggcttagaaaatccagtgggaaatctccatccttcatcctcgggacaaacaagcgcttcgggcccaagatcagtggcaccactgagttctcaaccatcgttcacaccgaccctaaagtcacaggaattcatgcctcctccgccgaatattcaaaagatgttgttgatgaacggatatccaattgcttacatcattctatggataccaggcatagcaaatcgtcttgttgaatcaacggctggctcgtctccccagtggctcagtattctacaagcatcaacacagtttatcggcttgatcaatgcattgacatatggattaagcgaacagatgaaacgtcgtgcttgggaaagttggaaacaccgacacgactttacaaaagcaaatggttaggttggtttaaggtatttatcttgtttatcttggaactggagttaggttattgcattggcggcgcctgtttttgatatcccttttttcttcttcattttggtagcattagcaagcgggtttggctcgatgatcatttttaacgaaatttttcacgactcgggaatggagtattatctttcacacttccttctatactcttgaaactataatgagcagcaaactgacctatgggcttaaatgctgcttgaaaaacctcttcatccgccctagggcaggtccattcataccttcgcagtgactcccatcggggatgaacaccaattcgtggtccttatcctccttgattagcttagacacgaggcgcatcgtggctgcaggatctacatttgtatccattcccccgaccaccagcatcaacttgcctctcagcttgccaacatgggtgatgttcgagttctcctcatatgattcatccaccggataccccatccactgctcattccaccagattttgtctaaccggttgtcgtgacatcctgaatctgcgactgccgctttgtaaaagtcgccgtgatggagcaatgccgatacggcgttctgccctccagcagaaccccccatgactcctacacgcgataaatccatccacggtcttgtttttgctgcttctttcgtccaagctatccgatctgggagtccggcatctttgagattcttataggccacatcatggaactttttagacctccaatttgttcccatagcgtccaacttaacaacaatgtaaccctcagaggcccattcacggaagcgtgataatgattcgaatccctttggggtaaagaagtcatgtgggccagagtagaggtcctctaatactgggtacattatggtcttgtcgaattgtggcggccggataataataccgtagatcagggtctcgccatctcgaccgactgccgagaatctctctgggggatcccacccattttccttcaagtcatgcgccgttctttcatgcagcattagctggacacttcccgtttctgagcttctcacggcagtacgtggaggaaggtcaactctcgaccaggtgtcgacgaagaagtggttgttaggagaccacttccaaacatgtgttccatcaccctcggtcagtgcttggcagccggtgccgtcgaagttgacccggactaaattcagatgatacgggtcctcgtctttcctatacccatacgcagatacccatattcgctggttcgcctcattaacatgttcaacatcgcaaacattccacaggccttgtgtgatctggttcttcacctttcccttctccagatcaacaaggtagatgtgattgtaaccatctctctcacttgcccatatcatcatgttggactctttgaggacttcatatgacaacttgttagcgtagtttatgaaggtgccgctcttctcttcaatcaacactcgcaccgtcccatcaagccccattgctagtacgcgcatgagctggtgaccacgctcattgaagataaatcgatactcaggtttcccatcctttacgccccaacccaaacttatcatttggtatgggtttgcaaaaagagcatcgcttgtttcaatctctgtcttggttcccagatcaaacaatcttgggcggtcaaccctcacacgatcgcctggtttcaaatattgcttcttcgtcagcttcggctggagttggtcgtccggtgcgtagttgagtaggtgaagggaactctcctgttccggcgtgaattgccaagcaatcgcaaatttgtcgtctggtgatttgaagaccataatcttatcatagggctgctcttccgtgccattcttagaaagctgtgtgcgcagagtcccatctgttcctgtttcactcatccataaattatactgctgtatatcaaggtttatctttgacgtttctccatccggcattttttcttcattctcacgggcggaatttttagcttcatcgccagattttgcgtcgtcttctggagaaggttcattcacgatgacagcatcatgcccagtgtctggaacgtgatatatggcttttatctttccgctcgacgcatcctctagcctccaacagtggccagagtatgtctcctggctcctggcttcgtcaggtcgtattgcgccgtaatgttttggctccccttcgaagttgatccagatgagattcagcgttccctctgtctgattcgtaaagcggactctgaccggggaagtactcaatgcatctgacggttcctcgacctgcatcagagaattactctcttgcttgaatggcccatcccattccaccaattccgtttcgtattcccatttcttcccctttgctagaaagcgggccgtgttaccgtctggtgtaatttcaatccagaggaaaggaagctgatggtgatcaaaatctatccccgtcttctggcccagctcctttgcaagcttcccatggtcaaatgcaggcctgaaaatcttatccgctgcatgaacaaacatgaactggtacttgtcatcgtcgagcttctgacggtaccaaaaagaatcgccaccaggggtccagtggggtgtgacagccgtctcctggagacagtgatcctcgattgaaagcatgctgtcgctcgaagatgagtcggggtcctacgatgaataatggaggagagggatgaatgtcacttcaggtcgaccaacgaccaacagatagcatttatcagcatcgcctaaagcatttgaggagccaacgcccagcccctttatggcgggggccatgtagtgttgcgggcagagaccacgttgagacccaatacgcgccaggcagccgtcatcataagctgaccaacttaaattgcctgagaatttactgcataaagacttgaattcgatatcacacatatgctgaggttcaaatggaaattttggtttaatattggggttttattagatatataatttacaggaaaagcgagaccattgattcagctggtgtttgaatgtgcccatgcgtgaacccagttggtgcttaagccaatccctcaacaagaatgaaagcacagaaactcaaaagttagattaccgccaagtagtacaatgtgtgtgatttccggtgattttgtatttagttgattgcgatgcgtcgcgtttcgggcttcttcgctttcgggacatcaatggtcaagatgccatcactcaaactggcagtaacagcgtcccggtcgatgcgagcagggaagttgaaatggcgcgagaattcgccaatgctgcgctcagtgatccagtactttgccttgtcagctggagctgcaggctcgtcctttggggttgaatcggtggcattttcgtcctcaaccgtcgcctgttgggattttggagactcgccggcctctgtgatggccgccggaatgcccgcagattcgaggagaccggtgggtgaatttccagtgtaagtgcgctcggtcttgccgcgaataaccaggctctgcggctcagggaactcgatggaaacttgctctttggtcaggccgggcagctcgccgtggagatggtatgcggccgatgtctcccgaacgtcaaactttggttgccaatgagagatgcgtgaggctcggccgcctgagatgtttccgctgcttccgctgcgagagtacttatcaaagtcatcgagaagacggaagaggggtgtgaaggaggcgtcggtgttgtagaagctttgggggaagagagccattttgacgatgtgatgagggttgttctggagttgtgattggtgttttgagctaggaattgtggtagctgtagattttggtgctttgtgaagatgcagaggcccgatgaaggagcccgattgcagtcttcattttataattgattgatcgcaacatggtgtcgacaggcaggttgatgaaggttgttgtgtccaccagaatcgaaatctctcgaaggcgctggtgatattcgacagcgtcctagttacagtgatgaagcacctggaagacggtggatagtgctggaaagtccgcgaatgccccactaaagcacatcagctgctggtcaaactcccttgccaagtttaccctaccctatacccagggaatgcccaacaccgttctatcatcaggaatagaggtacgagccttaggatgattgaatataggtacttatatcaaaaacgcatttattgactgacataagaggtttttgggaagattcactttcaaaattcgtctgtcatcttgaattctagcagacgccatgctatctgatgtgaatacgcttcattctccacatgaacactctctgacacccttcaacaacaacggcgtaatggtcggcccggtctacgacgcgttctcggactaggctagtttttcgcgttaaaaattgtagctataaataaaaactgtgcgtgattgtgcaaagaaaaatacaaatcgagacaaagtgaaatttctttggccattttcatctttccacgcgcgcttacaaacaagtaaagattgtgacacgttgatctctgctatccacccacaatgcctatcagcaaaaaggacagagtaggtctcttccaatttcttggcttgcctctatggctcggtgatatctctcctttatcccttggtgcttatcataatgtttgtgcagcgtaaccgggagcagaagaaggccgacgctgctggcactcgtgcccccgtgaagcggaatggacttcctgtcaaggcccccaagcctacctcgatcgtcagtattaatctttgtgtgaatctattgcttgatgctcatgggcggtgaacgcgggtggctaaacttctctcccccaaaatagtgccaaaactgccgtaaggagattgtgaacaccaacaagatccagttggaggttcatgctggtactcacgatgagaagctctggcccaaggagaagtgctggccagatgatttccccgcagccgaagccgaagcctaattcgggcgacgttattggagaaactatgcaaatagtgaacataattgtgatgaaagctatgcgagcggctcgtttcggaaaaatataaaaaccacagatccctctacttctaaatgaatgacattccatcctttgattttcaatctaggaggtcctctacttctatacttctaaacgaatggcatctcgtcctcgaatcctcaacctaggaggtagcccgcagtgcttccaagttgtaactaatggagtcctccaaacttgtccatcccgggagcccgagctccttgagcaactgctccgccttgtgtcgaggcgggatctcatggggatcctcgccgccgaagaaattgtcagggaacttgcggttaggctcttgcttcctcatgatgtccaaaatcttgtcccaggaaaagcggtcggcgaagccgaaaagcctctgatccttgactttctcgaacagagcgccaatgacgtgaaggcggccaacatcttgcacgtcgacgaagtactctgggatgaatgtcaataaccacagttgagttagcagcatcaacaaaggctttgacttacgcggattttgcgctttatggaatgggaggacgtctccgttccaaagagccgggataaggccaccgctactcaggtaaccctggcgaacggggtcaagcgatctgccaaataccaagttggggagtacttgcgcaagagttagttttcgggactacccaaaacagttcctctattctcacctgtattgacgaccaggtcaggcctcttgctacggttctctcggtgaaacttccatagttcctgctcagcctgggttttgctggcctcgtacacccgagcgccatgatcagcggggtaagggggttccgaccaggcacgcttaacagcccactcgttctcggtatcatcggtggcaacgattggaggaacatcaggatgagaagttaccactgcggcggaggaagacgtgaagacaaatcgcttcacgctcggctcggcgtaggcagccttcagagcgttgagcacaccagctatgacctgggggatcacgttcttcgggtcggggtcaaacgtcatgacagaagctgtatgaacgaaaacctggacacctggaattgattgtcagttcaaactgcggaaagcccattatgcgatgagcaattgaggcttcacagacctttgattgcctcgtcgaacgcgccgtccttggccatgtcgtcaacttggatgagttcaaacctgcccttgccatacttcttctcaaaaaggtcggcataccaagcatgcttcaccgggtctcgaacagttgcccgaacattgtatccataatggaggaactggtccgcgacgtgcgagcccaagaagccattggctcctgtcacaagaacgagggagcctttggggagagctgggttttgcagaggagacattttgaaggcgtatgagcttccgtgattggtgttatctgtttgaagggcttgaaagtggtgcgatggtgaagaaaatcgatcgggagcagtcaggacgtcgacattcttaaatacccagcatctattgtattggatcccattatgagtatattaaattgcctgcgatgacaaattttcggagcgagcatcgtgattgacaaatttcatagagggagcgtcgtggtttgttgctgtacgtgcaggtcacatcgcaaaaagttgcatgctcggatgacaaattcattatctccaggtacgaacgccgagtgtccacagccgcacatagcccatgcaggcattaacgtcagccgggtcggggcgacttgaagaatgacttatttccttcttgggcatgagattccgatgcaacaatgaaagagattttacttactcaagatgccacatgtcgataaaggcttaaataatcatgatgggggagtagctgatccactgaggaattctatctcattcaatatcattcaatttgatctatgtattattgtttctctatatgatgcgggtgaaagagctcgagtacaaagtaaaaaaacagcaatggaagatgccagactcgacatctcaacaccatgaatatttcctagtcttaaatgggttccagctcatcctcttgttaagttgccgcaggatattcgggttatctctccgcgctgaagtttgtagcatgttttcgtaatagtcgcaaggatcatcgacgcgagcgccgtacccaagcagaagctgcacaatttcgtcattccctcgagaagccgcaacagtcagtgctgtcccatttagaggggcgatctggttgacggaagctccgttctgaagaagcagtttcgcgatctcgactcgattcagggctgcagcaatatgtaatagtgtaaacccagactgatcatagctgttgacatcaacgccactttgtatcaggcgccgagctgtctcttgctggtcattgacaatcgcattgcgtagagtgttaatgcctgcttctcgagttttacgtctgtaaggtcggatagacgcctttatcttatcgagatcggatttcatccggcgactgatcgccctcgcccctgatcgttgttctcctggacatcgggagaactcatcgaaacctttgcctttgcgagtatatgtatctattacccgcactatcgggtagaagagaatctctattggagagttccctgtctcgttcacttccatgaactcaatgccaagctggagggcgaggttggctccttgaggtttggacaccatccttggaacatttgatccggagtcgatcccgacaaggagaagtggcatcaggggcacacgatggcattggcaaccgtttcgacgcatgtaccccacactgcgcgcacgctcaatcttgtcgtactgatctgttacctggcgaagagcgtttttgtttgtgacgctgtatgccaacagtataccatcagcttcccggatgaatttgtcggccaaaattgcgtatcccttagacgttgaggtgaaaacttcggtcataaatggtttctctctggttccaagccgaagtccggtctcagtaagtctgtaattggcagagtccgcattcattgtgctgagatgtcgggtctggcgtcttctattgttgtttaactttatactcgaacgctcttccgtataattggcagagtcttgtatccttgcgaaatggtggtatgagtattgggttattggggcgactttgtcgattccgctcactacaatgagtagtatcttcagtgggttgatggttgaatcgtacgtattggttgattcgtccgtactggttgaatcgtagatggttgaaccgtgcatattagttgaacggtaaatactggctgaaccgtacatattggctgaaccgtacatattggttgaatcgtacagattggatgatttgtacatagtggctgaattgtaaatattgattgatttgcgaatgaagcgatgattgaagatggagatgggtggtccggaatgctgtctaataagtatgtaattcaaactcatgctcattatcctacttgccgcctggcctccatgttgccggccactgaggcttagatttttctgcctcggaacctgcgaaaggacaaagcccccgttggccgctctggaggccgggctcacacattgctttccttgtccgcatcagccccgccaacatgatgggcaggggtcgattggacatccaacgctgtaattgattgacctgcaggcttcggttgtggcagcgggtaacagcgggcgcagtattggagggctgacagcgcctaagaataattaaggtcgcattggcggttgtctctcggtctcacaactgatatgcagtgcctcctcggcccaggacataagcccgccgcgtctcgtgacacttccaccaatgtgatgatttggaattaggtgcatatcgcagagtagcatgtcatcccattggaacgctgacttgctgctctcgaagcataacgtagccatgcgttttgacagtgagggtcgtttatttgctaaagtttgtgttctacacaattgcggcgaatgcttggaccgaacctatcgcttaccaagcgataatgtaaataaagcagaccgagcgaaacctgatgtctcatgtactgaacattctggcaggtgtcgaattaacctcttcctcaactagtaactagcttgtggtacgcgtgggattttgaagatcttgtgaagttcctcctcaacaacaagagagctgtgggcaccaagcactgacaaaaggtctttggattaagagaaaggcacggaatattgataggcgatcattgttaagatcctacgacactgccacatctcacctcgattatcgtgcattatatgttacgccgtgctaaatttgacctacccattcctttcacatgccgtgcgagcagttcgtgagggctgtcccaccgacattgattgatattccaggtgtcatctttctcggcttatatctttggggctctgccgtccagtgtaatgcctatctttgccgcatttacgatgctacggttcggaggggtcgtgtctcgggaggaaatggatcactcggcgcgctgggattatgtagtcgatcgccgcactgctcctctcccatcatgcagttctggagaatcatgatggccgctggattttcttgccgctctcaaataggtctcaaatatccccgctgtatctgatcgttcgttgtaccgccgcgtcatattttcggtcgggttcgtggggattcgaacacttcgttggcgattcttgaagccagctgttcgagcaaaattctgttggtgattgggaaatggacatcaagccgcgctcatcacccacggcctcaacacctttgccgcctggcttcgctgggatgtgttggttggttggttggttggttgcatccgtgatcaaatttcggagcaattgaacactgccatcacgcaaccccacctgcttatcttatcgtggcaggcttgcttagtaatgatattcatgcaatctcgaagccccagtcgagaaggttcatttctctaaaaaatctgccataatctgttttcggtggcggtatgtgtgtgtctgcatagcttccatctattgtaactagtctacggatgccgtaaatttaatctcgacccagggcaagtatacacttcatgccaggttgacctaggaagaaaatgaatgtagcataaatcacatcattagccgtggaagcaagcgaagcaagatggattttaaatcgcggtttctttgatcctgaatgcactaataggcatcagcatctaggaaaggaagcttgccaagactcgctccagcacgccgaggtacacctttaggttggaaaacaatcaccgtgaaggaaatgaataatgcaagtcttggagcgcagggaaagagaatataagttgttctttagacagctgctgcatagtttgtgtccaaggactgtggttggaactcacccaattcccgggccggttgctgctgctgttttcttcatcaccccatgaccatggatcacagctgtccagtgtacaactggccctagagtcagcatctacccgagattaatacatgttagatctcgaaacgggcggtttgctagctcccgaaggaagcctctcgagctagctaccgagacacgagtcataagacctttcgggaaggctcaaacaagtgcaagagctagcagatgatgccgatgttatcatgatcccttgattggtagattacggataaattgcccgagttagccctctgacatcagattcgccatctggtctagtccaagagctcttcgatctcctagggagtgaatttttgtctacttgaaaaggacatgtggaggagatgccctatgaaacaacaggtgaaccatcaaataaatctgcgtctgagatgcgcgatgatctctgaaacattgataaggtctattaattcaatattgtgagtttgggtatatgattcatcaatgatataggatttgtcggagggtttatttgctttgctcctgcagaagatgaccgtatatagaatccgtctcttttgacctccgactcatgagagagtccaagtaggaatgtgagcgtaattttgttatttggtgatagaatggtggctatggtctaattggcgaataggaattcgcgggtgaccaacagggacatttcaaggtatttaattgattcttcggaaagcaaccaacaggccagcttttgcccttgccatcgtagcacaggacggttgcggggtcaagatgaatgtcagaacaacaaagtttttggaatttttttctcttcgttaattttagcagtaagtttccaatacagtttccttttccttctccagccactctgaaaaactagtcagctgaatggcggacgatagctcctccatgtccatgtactcggcctgcttcctcattacccggtctgacatcatgaaagagaacgacactgcctgcgagtcgatatcctcatcggtcatgaagtactcctcaaactccgtcccagtcgcctcgcccaattgttccaacatatccggcacgctcaacagctcgctggcgaaagggatgccgcgcccgtgccatttctcagggttctggaatatcaccacgacaagcttactgatgtcgtctgggtcggcaagagctagcctctcgccttccctcatgacagtttcccagatgttctcctggcgcagatgagggaggaagtagtcgacttgtggtgtgaggaggttgttcatgaagaacgccgggcggataaacgtccagtgcttgaaaggcccatcctctatggcctgctcgatgaccctcttgccggtgatgaccatcttgaagaacggcgacagggtgggatcgcccagcgtcacgacacccagggatcccgagagcgcgacctgctggacttttgcggccttggcggcggcgacgatgttcaggccctgtcggcgctcacgatccggatcgtcggcgtaggtgatcgtggagatgaaaatcttttctacgccgctcatggcggccgtcagcgaggcgacgtcatcccagtcgcccttggacagctctactccggcggccttgagctgcctggccgcattggagtctggggtccgcgaggtccccttgacggtccagcccagccgtcgtaattgaagagccaatggcttgccttggctgcctgtgatgctgcagaggaatacggaagggggtggcatggctcaggatgcgcttttgcgtgtgggttcgtgtctgcgagcggggtcgctgtgggcggcgtctcggtatgtgcctctgccagaacaccaagattttaattgcgtgcgtccgagttggatgggggggtaggcgacggtttgcgggtgcggcaaatatgggagttggaggatgctcggcggccttgcaggctcgtcagcagtctcgagcagatcctggccctattgtttccctctttattaataattctcggcttggctcctctaaacgcctgcgcaggctaggttttgatggcttcttatcgtcgtcaatcaggggccggttgttgtaggggtcaacccagaggagggggagaaagaactttgcgtcttttcccacctcggcctagctggcgccaaatctaattctacggctgaggatctggagcaccggttccattccagtaggcaagctgtcggacggtcggtcgtaggtcgatggggtatagcgagtgggctgcaggatgcataggcgccggtgggggagggatttcccagcaactcgagcgaaacccgagccagcggtctagatgtcgtactagccgtcagctggcatgcaagcctgttggtcaaaatctcagtgacagggattgacgttcagctgacagccacaattcagagagaagcccggatagcaccgagctgcggtcccgctctttacgcacgccaaccaagcccaggggctgatcattaccaggttacggggatatttatcctgaattggccaggcagccaactgcttccctcgtcgtaatgatttatcaggaggctgggtatatatgaacttgtgtgccgtcgggaatcagaaacgttagcgatatccgacgcatagaacccctgttaactttcttcctactaaatattactaaagtcagccttgttagcgtaggaggctaaccgagcagattgtattgtctcacatgtaccaagtttttgaacgagctacctcagcagctcgaacacagacgtctgtatatcaagaaaccgatcaaggtaatcgtggtcgtcttcctggtaatggaacgtgacgcgcaatccagtctcctatcattcccacgcctctcactcgaaagagatagaagaatccaaatgcgcctgcgatattgaaggccacaaaggcaaacccaactccccagtccatccatctctggtaatagtacatccccgacctcgccaagacctggtcggccgaccgcaaagggcaataagaacagttagcagtagcccctggattcagcagtgcgccaggcgcgccattgtcgaggaatggctgcatgtatgatccacaattactgccccttggaggttgaaagacggcgatttcggaaggtgagcaggtgatgggagttcctgatagacctgagacggccgtaccccctacaaagtatgtcatcggggacacgcgatacatgaaaatccaaaacctcggcagggctgttgggatttggaatacgcctgcaaataaaaccatcatggagaacatgatggttgcaagacgggcagccgttgttgcgtctggcaatggcgccaccaccatcaatgcaaaggtcccggcaaggatgtagaagtgaatgaggaagatgcagaccaacccttgctcctcagctgaacggatcccgaaaaccgtgtaattaaagattgtgaatgtgcacactcctaataatatgtgatatgggagctcaacgagtagattggcaaggatcagaacgggccagctgtacatattggagtgtcgttcccggacctcatagatcgttcgttgagcgatgaacctgggcataatctaaatggttttgttattcaatcagtcaggtgctcaaccccccccccttttaacagcgcgatcctcttacctgctgaatcaaactgctgaacgttgcacatatcatgagtattgagaatatcttgttttggacacccaggatagaagcgggaccttggaagaaggagaatccaatcaataacgagcagccacatcctagcataaatttactggcaatatatgatggtgatcgccaataattttggaaaaccctcaagcaaatgggagatatctgtgacaatagagggactgggtaagcgttcagcgccttattgtctgccgcttgtttaatagtcggtatcttttgttgtttcctgcgcctctctgaagaagagtctcttgcttgctctatttccctccgaacatcatcggcattcgaggattcagcccaagttttcgcccagtcaggctgcgaactgtcattatctccaatcaatttgaggagatgttcagcagggttctcagattcttcgcatgtcctgtgcctagggtcatgagcagcgaagtattgcagcacgacatctgagttgtccccaatgtctccaaaatatgcgactctgccgccttgagccattagtaagagccggtcaaactgttggaacagcatcgcgctaggttggtgaaccgtgcatatgatcccaagtcctccagctcctaatttccggagaagagacaaaatggcttcggacgattggttatctaaaccagaagttggctcgtctagaaagagaagccgtgatggtctcgccgcaagctcaactccaatgctgagacgcttgcgctgttcgacattgagaccttgacctggtatccccacaacggcgtcaccgacctcggacaggccaaggaccttgatcacatcttcaacgaaggccattttttcttgctttggaatgtcaaaaggttgccgtagcaatgccgatagctgtagggcctcgcgaactgtagacgtatcgagatggacgtcttgctgctggacatagccaatgtgacctttgaaggaagcgtcgataggctccccgtcaatgtaaaactctcctgtcataacacagtccgatgatctttgagctagtgtgtttagcagtgttgttttccctgctcctgacacacccatcagcgcggtaagagaacgcggtcgaacccaaccagcggcatcatctagaagccttctcggttggcctttcattaacacatcaaggtttactttattccacgagaatatctttccctcccgatgtagagggctctcttcacttgtgttgacacaagcagcgttatgcaagtcaggttcgttactgatctgtccttggccctcggggccactgtggacaatctcacgatgtaagtcgttctgtaaaaagtctctgggtacatgtccgcgagagaagacaaggacacttggtccactggaagaacttttaccgtattctgtagtgaccaggtatgtgaggaggaagaagaaaaggaatccaataatgataccgtagttgcgccagagatgggagtaagaatagccatagctggctccgcaccaggattcacccataacgaaggaatgtcctgcaacagcacccgggactggacatatgaacgtgtcacctgttgaatctggatatggaggaaccaggcccgcacaagggtattttgctccgtggacctggttcacaagaagtgcctcgaacacgtatgcgagtggattgatgtacgatatccacttgaaccatggatgcatgtatggccggggtaaaatgaatccagtatatgtaactagtgtcagaacgaggaagccagatatcgcaagggcggcggggagcgttttagtggctgcggcaattgttctgaacaccattgacattgtcaaagtggctgtaaacacaaagaggaaaaaggtgaaaaattgggcggctgttcgttccgcaccagacaaaaagtaaagaatagcgttgaagagtacggcagtcacgaatttgattggaatgtcggccagtatgccagcaaacgcatctgctgaaggtcgatagaacgcataggaagtctgcttttgaacaactgagcgaccgctgtataggctgtggatgtctgttacagccatgagagcattgaggagtacggaaaagaaaagaacagagccgtaagagaagaaagcattcgtgctttgttgagtgccatagaatatcgatcccaccacaagcgaaatgacgacctgtccaagtagtgcagtataagtcgatgttttattgttccacaactgctggtatctccttttgatgcaaaggcgagtttgtaacggaaatgaaacggtctggggggctctgttcagcatccatttcgacttgatttgtttgcgagcgagagaaaactctctccgagtggcctcagcttggggaattgagcgtttttcgtattcatcaatgtctttttgaatcgctgcatactctggagacctatgccagtaattttcgaactccatagctgtccttggaacccgaccttggaacccttctctgggtgtcctctgcatagggttcgtgatagctgtaagaaagtctcctgccggctgcctaggaggatagtaccagcccatgctttcgaaataacttgtcgctgaagaagcctggccgaaaaatatttgtcgcccttcgtaaagtatcagaatcttgtcgaacatgtttatcatagcttgtgaacattggtggatggccgctgcatttgctgcttgagttactagataaaaagtcaataatccaccgattctgacaatgtgaagagttaggacctcctacgattagaaagagtacgaagccgtttgacaaaaccgagagccgattccgcgtccaaacctcgggtggagttatcccatgcatagatcgtggcctcggcaaaaaccgtctctgcaatggataatctcttcttctcgccaccggatatgcctcgcacaaagtcatcaccgacgatagtatcacgcgtgtgtgacagcccgaaaactctgagcaaaacatctaccgcgtgtttcattcgatcttctcggctgattcctggtatccgagttcgtggagtgcgcatcgccgcagcgaactcgagagtctgtcctactgttaggtagggaagatgctcatccacttcctgattatataaagactcccccttgaatgtctccgccataacttcgtgcgggatacctatagacttagctgagtgatcgtcgctattgatcgtgcagaatatctcaccagagtaatgaagcactgagctaggttccaccttgaggttcgacatctcgccactgatcgtcttcaaaaaggttgtacacccgcttccagcacgaccaagcacaaggagaagttctcctttctggactactccatcaagaccatacagaatagttctggaaggtatggtccggaatctcttccaaacctcgtatggccaagccaaccacgtcgaaatggtttgttgctcaccgagtgatacaccatttccacggatggttagattcttgaaacaaaatccagaccgcggcgggggagatattccgagttcacttctcagtcgagctattgtactggaccatctttcgaagtcaaaagagggactcgagggatccacggtatggtcattaatcgcagctttcgacaagatcttattttgcaacattttgaagaaatggacccagccgtttcacttcgcaacatgtatgaatgagtatggcgtagaggcaaggtgaatgttgtgtgttctttgggtggttggatgagcatgaatccttaagggtcttacatccagctttgtttttttcaatgatattgttggctcataggaaccgccatttgctagaacttttagcgatttagtatcctctactgtctgtccaaacaagtgcaaagacttggatgtaatgtcttgtagctgtcgaagtgtaaaaccagcttccactatgcatacgaacattctagccttaggccgacagatatgacgagtgactagtacaaagttgctgcatcacttgtcctccctggtaatctctgcgctgagaaaagctcagcgtagctctgctacgagctcagttctatgcctttcttgcggacattaatacccctgcaaactcaatcgccgcttacggagtagctaagaccagtaaagaattcctgttttcactggtagctttttgtagggcataagtaggtgtccagtctgtttccctgttgggatgccgacctgggtccagaccgtggaggtatgtgtttgtaaactctaattagtgtattccacgttcaggtcggcgataacttaagtggatggagaatgctctcaaacccctttacctttcctcttttctcactatggtatgaccagtatctttaaattgccacatattgttaccgatgtgaacccaaacctggaccccctacatcaaactttgggttaagggggcctaccaccaggcggccgacgtgagctaacaaatgggctgtcacctcccccccctccaagatcctgctacatctgatggtgtgaaatttgaaagctgacggcacgccaatttgacagccaacgagcttgtcttcgtattgtatatcgtcatgaatatgacagattttatacagagggcttagactctgagcacagctgttaagcacagctacggcaatctcatgttcctaggagatgcccctctccagctacatgtctgtcttggaggaattatggaaacattgggagtgaaacttcatctgacgtcaaagtttagctccatcatctcagctatacctaggggcttgtctagtgcggcggggtcgaagaattaacagctgcggaagatggtgtggtaatgaagattaaactttgtacacgtcattggcttagttctcccaaaacagaagcaatagctgagagctcaccgacaaatggacagcctcagttttcagctatggatagaaaatgcttccaggttggtttcgtagtaaagtcttacttcgttaagttttgcatagcttgaagcaaataagcacatagagcctcacacacaaaccattcctcttctaccttatatgaggccccgatatcatgtaaaaaggcaaagcaaaatggacatcgattctctgaactttgtcttcgactttagcccaaaatttacgagcaagatgaggtgtccaaaggagcatgaaacgaccgaccagtcgtatttgaggggaattgttgatatggggaggtgtgttgcttctttctccgcgcgtcgcaatgtgcaatccagctaatgtttgccctttagcaatgggatccggttttcggtcacggacttgtctcctccattctctcgaatacttccaacaattcacgtttatcgtgttgacatatctctctatgattcgcagtacgacgaagagactggagagcaaattcctattcctcagaatgttattggggatatcatcgccgctctggttcgcttcaagatagtatgtaacgatctaggagtgctcgaatccaacattcacattgtcgccacagaggcaacacgaaaagcaattaattctgccgagttcatcaaagccattcagtcttctactggcctcacagtcgatatgcttcccaaggaaactgaaggccgagtgggtgccttgggtgttgccagcggcttctcgaacataagcggcctcatgatggacctgggtggtggcagtactcaaatcacctggatcatttctcagggtgggaacgtccgcacaagcgtgaagggttccatcagctttccttacggagcagccgccttgacccagagaatggacgacatcaagaaaggaaaatcaaaagaggaggctgacaaggggttggcgcagttacgtcgggagatgactgaaaacttcgcaaatgcctacaaggaattggaggtccccctaagccttgtcgaaaatgcggaggcagaaggaggattctctttgtacctctcggggggaggattcaggggatggggttatctgctgctatatatgagccaacttgaaaagcaccctcatccaatctcaattattaacgggtataccgtggataggaagaggtttgaggatacaaaggcgatagaggaagttgcaaaatccgccgacaaggttttccgggtttctgatcggcggagaaaacaagttcctgctgtggcctttttagtcaacgttctgtcgcaggcgataccccacgggttccgagcagcacacttctgccagggaggtgttcgggagggtatattgtttcgagaacttagtcccactgtccgcgcacaggatcctcttgagattaacacccagcgagtcgcgcctgagtcggcgggtgccctcttcaagcttctggcattctctattccagagccatcgaggcaggatgggcgtagctttcccagcactctcgacagtcatgttatcagagcctttatacatattatgtatgtgcacggcatcatggataaggagctggcctcaaccgcagccttgtacagcactagcactgggctattggcttccacccgcggggtgtcacacgaggacagagccagactcgctttaatgttggaatccagatacatgggggagcttccccctcgtgagaccagtttcatgcacgcccttcggcgattaattactccggaggaggtttggtggacagcatacctagggcgcatcggatatttactcactcgcctctatccagcaggaaaaatcgatgagacgaagcctcgtgtggttttatcatcggaatgggcctcggatcttggacgcaagaaagataaagacggtgtgcgactggtggtctcagtgcagaagatgaaaaacgaccctgcgaagctgaagaaggccttgcaggacaatgtcaagatagtagagaaagttggcaagaagaagaattggattggtggacgtgacggatggggaatgaaggtacaggtgcacgttgaggaagaggacataatgtagcccccttgctttctgagaatgtccaaagatattttcttccttctgggtacagtgtttgtactatttgggagccaatctaccgatatcaaacagaatgatctataaggaattaagaagcataacctcgttcatctttatctccaaccgcaatacacatgcgaaattatctacatgaacaagattgattcttgatagcaataagtatcactaaacagctttggtgtattttgtcaatgaagaacaaagagaggtagtagagtcagcctgcagcttcaagatgaaggatcaaagtaatgagaaagcaactttaataatgtagattagccactgaaaactatagccatcgttctcaagtctctcagacatgacatccactcccactttgggtaaatatgaaataaagcagattgatatacacagcccagaaatcttccataatgggcccgaattacttcaactctccttgattattccgccactccttccttcctgtctctcatgacttcccctaaaccgaagttggggccggcgcatttgagggcgcggctttgcgacccctgagtctggatgatgcggaagaaaagttaaatcgaccgcagaccacacaaaatttcaaggatggcttacctggagaaatggccttgtttctcctcatgcacgtcagcgacttcgtgatgtcggtcgcgattcttccatgcccgatagaggcgtccaccctaagacagtgttaatatctcggtaaacacaacgatgagaaagaaagagaatggacgaaccagaagggtactgccaatatggattatacaagcaatgaacgaaaacgctagcaccgtcctataatcggagcagccggcattattgacacgcacaactccgactgggccagtgcgccaccatcgaccccagtagtatccccagtagttgttataccacgtggagctgcaagcatgaattccagttctctataagtcatatatattagcacctgcctcacattccatgatacgatcaagccatacactttccaagaggcaaaaggccacgagccacatgataaagaggaccgtgtcgaatgggaaggtgataacgagaggaccgatagggatgcatgtaaggatcgtgtacacaataccaagacaggcagtgaccatagtgtagataatacggccatcgacgtgtacgccagcaagattagccaagtaggtgaatcggctgaggatacccaaaacaatgacagcactgatgcactctccgagacggaagagtgcaaagagcacctttgaaacggtatgtctttctgccatggtgtaggagagatgtggtaaagatagattcagtcggtttttttattatccctcgatggataggtacttgcagtattgtggtacaatgtgttgtgggagaaggctcttaatatgagcaaacccaaagatggtagttgtcagtatacccataaaacatcggaattatgccgcacggtaggaattaaaccgattggacatccagctaagtttgtggtccgttgatttagatgacatgtgacgaagcgttcccgaggattgatccaatcgttgtgcattacagcttgcacacatatctggtaagttgtggacacgtaatggccctcccctccaaaagattcaagtaaaaggaaccaaactttcaatcgggatatttcagactttacttagacgccacaaaggaggctggtctcgaccatttgcggggttggttattcattgaaatgctaagtcataagtatatacgtcagtgtcgcgttgctcgtcttagtggcgccacctcctgtttggcatcccgggatcttcgggatgtctgatttacaagttattcaaacgataccgctttgggatgaatgtcaaatagcccacagaaacaatccaaacgtaggtatgctcaccagttcttgggtgcctagcttagcaaaatcaacggaaagtaagtgggctgatcacttccaagttacgccgctgaaacctccatcttattgtagccatggcatacatcccgtgagcctacatttggagggggctcatctttgaggactagaaaggtctgctgcaagaatctatcaccaacagcttcctccatttggtggtccgttccaagctgatcttttctccaaatgtgacacaactgagctgagtagccaaaacggccagagagctatgagagaggaaattttcaccactaatagggctgcgtctgctccaattatcacctcatccagctcccaaattggcatccaaaaagttctcgccgaccagggctggatttgtgaccgtttgcgttagttatccatattaacggtagaatcaagcctgggttatcacatcctcccactgactaaccgttttgaactctaaaccacaccaccaaagagcccaagattggttcttatactcttcagattgacgtcgccgaactcatgaccgccccttacccgagcacgaaagtcgtaaaacagcgacgtccacttggagttttcatatcctggacctgaacatgtagcgagacagtttctaaaaccaaagcttcgggtgcgagcgggatgacatgccatggtagtattcctcttcggttagtagtcgccgaccataggcgatcaatagagaccgttcaactctaaatacagatgtggatccgattgtggcaggtcttcagggtgtcatattgactactagaactgcgcctagtaaatgccatctactaatgaggcggctgtctttcgatttcccatctaagtgatacccggcattgtctatggctgaagtgacgtaaagatgaccaaacctattctctcaatacagctagaacggtcatttgatcaaagtgatagttcagccacaggtggtgattttccaagaatcgatctgccagctcgttaagcacaagtccctcgctatctggaagctattggtataccaataggcaagattcctttttctaatctacttggagtcgctatcgatcgatctaaatcttcatatgcacgatttggttacccttcttgtcctcggatgaaaatggcttgggtaatcattcagcccatggcttaggctagcacataatgaggcgagacacgtggatttcctcgcttgttcgcaaaacgcgtagaaaaacaggttaataatatgtatttgagtacattcaacaaggtctgctatccatttgttacgaaaagcatggccacgtacactgccaactatcttcctgactttaacctaaaatttcactggacagatatggcaatcttcatttatattagctagtaaggagacactttatcctatgcttcttcctgcttattggtttggaaatcagtttgtatgtaggcagcatgtatgctaattcaacctgctgcaatagattatttcgattgctggggcatgatcacaatgtaagaagggaggcatttaagaaagttcatcaatcaaccaagccaatttcctatctaggtacagtcagagtaaggggaaactaatacattttagacagttcaaatggctgtattcctgctcaggtactatgccctggaaagagccttggctggatctgcagacatacaggcaaggtggccaaacagcactgccctggttgcggcttcctattgatctcggaatttcgagtgtacaaatcctcgaagcaactatgcagacggaaataccataaccagaagatgaagcctatcgacttctgaagagacaatgggttgtggtgtagttcaggacaggtgctcttattgttgagagctatacaccttaagactatgttcatgctttgttttagagctttttatttaattcatattgatatttaattacactgggaaaagaacgaaaaacaaagccaacaacgtacatactaggcgggcatgatattcacaacgcataagaatacctagtggtggatcattgccatagtgtgatctcacgagcctcctacgtatctagcttattcggcgccctcgtccaaattagaacgagcctgtttttgaatgatattgtgatgaggactatctactattctgtatgatatctagttgcgtgataaccatttgagaaagcgtgcatggttttgtaggatagcgtgggaatccatcctgatagaatatcgacagctccttcttacgattgtatagccctccttccatcgagcaatctgcatattcaggtggcttgggtaagtatttttcagacactagctcgctcagggggtcttgttccaacattaatttcagcatcttttccattacatttaggtacgaacggacgacatagtaaaatcttgtaattacttggggggattcaaattcctttcttctagtttattgttaatgcggtctgatgttgattgtgcttccaagttactaccacccaacctggacaatgacgggccacaaacaatgttaaattcacttaattgggaatattaacgctggaagagaccgtgtgaacaccaagagcaagcattatgagtgcacacgatggagggaaaattaacaatggcttaacgccggcagtcgcgtgcttccgcaaaactactagatagttgccatacgataggtttaggtagggaacactccaaagtcttgaataatcagtattcccactttgtgttgagaagtgaatccggtctaattctccactatggacttttagctttaccatcggaatgttggatatctgtggcccatccctttcaacctaagaaagtaaacaaatccggccggcgtagcatccaagagaagcacaaacctcaaatgagagctgggaaatggtgaagaatcggggtaaatgacggaattaagggacactgaagtcatttgactttttcatccgtgctaggacggctttgtgcgagcattggaagctacgccaatgattcatcataccatacctagacaattcctgccgacgagctgtacgcattatacttagacgagagccaaggaatgctacgaaaccttctcactctcctagatactgccccaccgaccagtcccaatagatctttcttctcttatccgaaaactactccaaggggttgatgtctcacgattcctgtacttacgccacattttgtttgcgttattgtagcctttctttgcctatcgtggagtctcatggcactaaacatcacaaacatatggccgcctacctcttcctttgacctgcttagtctggtctcgtagtccgtgctgttttgtcttctgtcaatgttacattcgcatggctaaaagtgtaccacaaatcaatcgaatatgctaaccctcgaggcagagtcgtgggtgtggtacggcgttgtgtggctcatcgtcctggctcgaatgtagggtgtcgtctattgttacaagaaatggcagggagctgaccagctatgcggcctagggtttcgaggaggatgttacttggttcgtttaagaggtttcagatcgacgattacctcgtcttactcgctatggtacatcaactgatcccgcacatctgatttgcgctaaccacggggatcaggcaacacacactgtctttatttatttcctcttagtcgtcgataacacacccaataacctgatcgatccaaataacccagaagacaatgtggcattcacccccgaaaatattcaggaacggattcgtggatccaaggcaatatttgttgttgaacagatgcaatgctgtacgatttggattatcaaagcatgcatcttactgatgtactaccgcataacgtaggtcaaactgaaatcacacactaacacatgtcgtcaaatatactccattctatagccacttcagatatagtcttcgactcctgcctcaacaacactgattgatatcttaggatcaacacggagcaaaggtttcttgtcaagatcgcggctgtatatactactgtgtgcttcatcattatggagaccttatgctttgccgcatggtgtcgaccattcagccagtattgggcgatccatccagcaaatagtatgaaatgcccagattgataattgctccaagtgctgatggtgtttgaatagcccaatgcgctacgtatttgaaccatctcattacgaatcttgttgtcaatctctcatcagacctgctcatcttctttatccctttccctctattcttccgatcctcactcgacctcaaacagaagcttgttctgtcctgcatctttgctgtggggatcttcacggtctgttgcatacctctgcatcttcgttttgtttgtcgcccgtactgacagattgtagatggtttgtgctattcttagcaagacatactcgttcatcgacccctttagcaacaattggacgtattggtatgttcgcgaatcatcaacggctatcatctgcgcgaatcttccccctacttggcccttgatccgaaaggtctttgccatcaaatctcccaattcgaccaaagcaaattactacgctcgctcggctcgacccatcaacgtgcattgatgttgtttagattggcaataccccccctcaagcactattagaacgggagaattttggattggtggctcattgagcaacatggcattatgagagcaagtgcatgtgttattggcgagcctatgttgccatcaaatggtgttggaattattaacatcaagctaaggtagcggtcgtctgtgcggtctaatacttcaaatttacaaaacagagaagctcgtttgcaccaaccgtaagcgaaacagaaaatttccccctctccaacatgaaaataagaccctagacgagtcttttcaagtgtgttataccgagatagttagatgtagcgccagttcacttatttggggagaagttggttttcttctgagggtagatgaactcgagaattgttggccatttgatgactcttacgccctgaaaatacactagtgaaacaacctagaaccaagcccatctttgtcagatcctgttcaaagcacattgaacaaattatcaattgctccgactttggacggtgattgctaatggaaagacaacaatacttctacaagactagactaaatgctagacgtttatcgccgatgcagctggtggaacaccctacgtatatcgcatcatgattgatcaactactctaaaccggctgtgcaacttgggcgtcaaaaaccgtacatagacgtccattattatcctcaaaaggctgggtcgttgttttgtataaagagatcttcgggaggcctcccaacggcttcctgaagggtggagtactggtgccgagttgccgaggacgttggagcagtcatcatagacttctaccagggcaagggcagtttcggccaacgctatcttcttaggacatgatgtcacgcaccttcggcttgctctcagattttgagccaattattacttcgccatcaaattccttgcttgctaatcatatctgattctacagtggtctgccatgatggcagatgcgatctgggcaatccctcttcagctgacaaacttcaacatcgcggtcgctgtgttgggaggcttcatctcgttatttggccttgtttcataccaggtcaaggagaattactacctctccgaagctcgtgcgtcgttcatggaccatctttagtcaaccgaacaaatttgagtagggctgacgtttgaaacagtgatagcgcttctggcgggtgtcgcctttggaccaaatggcgcaaacttcatccgccccagggactatgctcagtgccatagtccgggaatttcggagaacgagtgtcaagataacctgggcgccattacgctgaacttctcccgacttgtacttggtgttcagcttgtcctcgccggcgtccaactccccagcaaatatctgctcaaagaatggaaatccatccttctgctcgttggtccgggaatgacgtgcatgtggttggctacaagtgttctcgtctgggcattcaccgggcggcccaactttctgcacgcactcgcagtaggggcgtgtgtaacacccactgatcccatcctctcagccgtaatcgtgaaaggtaagtttgcggaccacaatatacccaagcctctacaacatctcatcgttgccgagtcgggcgcgaacgacggcctcggatatccatttctattcttcgctctatacctcatcaaatatgtcggtgccggggcaacatctggggatgctggggatgccgttgggctttggttcgccttcacatggggatacactatctttctgagcatcgtgtatggcgccttggtgggatggatcgggaaagaactgctccactgggcagaggaacgcaattacgtcgatcgggagagcttccttgtcttcgcaatctccatggcattgtttgtattgggcacatgcggattgatcgggaccgacgatgtccttgcctgcttcatcgccggcaacaccttcacttgggacgactggttccgcttggagaccatggatgattccttgcagccaacgattgacatgattctcaacgtggccatcttcttctggtacggggcagttatcccgtggagtgccttccacgataacttggttatccctacatggaagctcgttctccttggtatacttgtgctgcttctaaggaggttaccctgggttttcgcgatgcacaggatgattcctcagatccaggaggtgaagcaggctgttttcactggtttctttggtcccatcggtgtctcagccgtcttctatttgtttgtgagcttggaattcattgaagaacatctcagcgagggagacaatgtccctcgtagcgatgtacagaacctggcggagacgactcgagttgtagtttggttccttgccgtgtgcagcattgtaagtcgtgtggttcagcctcctgcattgagacatttctaacagtagtcttgcaggtagttcacggcctcagcattcctgttgggaagttgggatatcttgcaccgatggcaataagtcgtacggtcagtttgagtctaagcgatgacccgcgtgcggcagaatcgggaggcagagttacgctcatcagaaagtgtctcgcctgggccaggaaggacgatgtggatgttagagatgctcgaccgccccttggtcccatcatcattaccgacgctcgcccccttccattgccacccacctgtgtagcgggatcaggaccaagcaattcaccccgtcaacgtgaaattcgattccctgacgaccttacatagcagcgggatgccggggacagtatgcttggtggagttgcgccagaagttccaaaatgtgagcccgacagttgcaagcttcgtgaactggtaacgattgggccagccactttcgggagctttatcgttcttgtctgaaaattgatcaatcgagaaagtacctgaacgccaatcaaaccaggccgcacgttcaatttgtcgcattaagtggtggtacgtatctcatttgatgaagacgtgaaaacggactttcatatcagggggacagttcccatacttgtacgtctcctcagtattgaacttactacattcgagtcatatctatcatatggtggattccagttggtgtttggagtctttagagagtaatttgtgctcaggtcaacgaaagtgtagagatataaattccccgtaagcatgtatttgcatagaactacagaatcagcttgcaaaataacacaatttttcaaaacctaacaagaaatagtctgaaaaatggcataagacggtggacaaatagtaattatttccttccccgcaactattgcgcaaactctccatatagccatgtcgctctggccactgctcgtcatggtagcttcaggtggccttgggcgactgagatccagcctatccaattcaaatcccaaatcatctcctctctgggtaaagaggagctccctgggtaagcgccaatactgtttctcaagtactcttagagtatagcgctcggatagcatctgcctctctctccaagaatttatcaaatgtcgaaagtggaacgccccagctcttaacctcatctatatcatatatcttttccatgtcacgtatgatagactgcccagcaataattgggtttgacgtcttctgggcctcgatttcctcgtcaggcattggaaccatcttgagctcgcgtccggtgaccttggacagcttctcgaaaatctgggtcactgtttgatactcgtccgcatagaggatcgcttttccgttgaaacgttccggatcattgatgaccgcggaggggaaagcccccaaggtttcgtcatcgaggagggggatgttggtatcgggacgcagagaagtgacgttggctccagtctcgacgagaccagggaacatggtattatggaaaaccaacacgttggtcatgaaatagcctggtcggaggatagtgaagtacttgaaaccggcatcctttacctcgttctcgatatcccttttagagttatgaatgaccgcaagaatactatttggatcgtagtaggtgagaacaccagtgtcagggatggagtggctagagtaaacgatttgagtcacgccggcttgcttggcgatttctaagatcagcttggcttgacgaaggttggcaccaaagtcattgaagtccggcatgaagttgaggaaaacggcgttggtcccggaaatagcctcttgtagagccttttcattgtcgtaatctccttgccatagcttgacacctagtgtctcgagtgcctttgatttagccgtgccaggatcgcgggtaagtgcatggactgtagacccttgacggacgaggtgccgtgctagagcacctccctggacaccagtagcaccggcaacaaagacagaaagctgagacatccagtgtgatgttctggatttggtaggttgagtagtagtgatcaatttgagggattgaagggtatcggtttggtgggagagattttccagttttcagagatgaggggaacactcatgcatatttatagaaagatgggaggatgggagtatgacaaatctttctcactggtccgcagaatgatgcaccatctcatccccgacggcggagttccgcgctgccgcgacacaacttgttttgaaatctgccacaaacccgtctcagttgggatcctattagcagaatatgacgtgtactttcctaggcatacatcttggttccaatataaataaaaatcccatcacgaagatacacaattgaactagcagttatgggtcaaatgaatcacagcaaggaggcgcaaagagactatcaccaccacaaaccgggctgcaaagtgtcgcaacagaaagctaaccgcgcccctgacactaccgggcaaattgagtctttgccttgaatttcactaagaaactgatttggtttttatgggcaagggcaaagttttacgacaaagatagttccaaatttccgggtggcaagtagctgatgtagaaaatggcttggtctacgacttgtgcaagtcaagattctttgttccctctcaagagcttaaatcatacaaagaggtaaaaatgttttcgcggtgaaagaagattaaagcctatggaatataaccaaatgatacatccagaaatctctaatagggaggatatagctaggtgtgaagcaataatccttgtatttaaggtcaactacctgttacttcatcacttcagtccttggtggctgacgcattgaaaaagtattagagccactcgttaatcaatataatacgcagagcaccgacccaactatgaaagctgtgtgattattcccaagccctcctacctactccatagccgtatagcccggctgcttcaagattctgaacagcctcataactaacatccttccagtcttcttctgcaacatcttccaaacagcctatgtcaaatcgatggccagcccatcgcccacgagtttccaaagattgagtgccggaagcatcttctgtccagacggtaaaagtaccaaggacctctcccaagctatatttcattgaactttgtgcaatagtatcgtcacggacgaactcttttgttgtcaaattgcggagaagcacggcctttttgggtggatgtccgttcgtatcagtaggtatgtgctgaagcacatcattgatcaaattgatggcctttttgcattctggtattgaccctattcgcttttggaggtgtgagaaaaggctaccagaatattcaatctcgtccgagtcgtaccgactccgttcaaaaaccgcgtctttctcggcaaattcttgctcaatggaatagtagagaggattgcgcccaccggccagcaactgggtacgctctgtttctgttacaactcctttgggaatcccatttgcgtagtcgccaatgaatatgagccgatccccagcccaaggagcttcattctcggccagaagtttttgcacgcgaaagccgagcaaacgaaagaagtaggagcaagtcagggacaggcatatcaattctccgcctccagccccctcgtcctcgacaagcaatgacacaatttgctcaacaacttcctgaggcagagcaataagtggcgattgcaggctagcaatgggatccggtaggccgagtcaacgatcgaattcgtggaacttcgtccaggtttggggtgcttggatggtctactcacctcttcagcttgcatgaatggattgcatatgatgatgcaaaataaggaacccattggggccggcgaaggaggccgacgagaggttcaagagctcgatctccgagcatctccaagagcttcaaacccgaatcatgcgcaagcaccttccgcttgtcaatattaacgagtttccagtattgacccatcttcatttagttagtgactgtgattgggactagttaagatgaattagagtctatcgaaatattttagccaggaaattctgatctgcatttatatccagtctgatcccctgtgattttgatacaaaggaggtctctttccactgcctctaacctgaccggacggtcgccatatgttggtttccaatggttgctccaacaacatttacaagtaggggcaaaccctgcactattaggcagctgtcccactaaccagttgttgcctgaaaccttgacgcttatgatggatctaattttaaggaacactcagtacagcacgattgctgacgtgaggcatactcacaccgctcttcgccattggtatattcctgcgttaacttttacagcgtgtttaagagtttccgagcactgtttcgatttgctctttctgcgaacctactgaagctcaagtcttgttttggtaaattgagtagccgctgtctcagacgccagttgctttacagaaacactctgctgggggcaatgccattaagagtattctccaatcatactggaagagtcagggctgccaaccagaccggataggccacgtacactgagtgattttgctttctcacatcgtcaattattcttatatacacttcccctgtagtaggaaatttgacaaggattctcagcctcaataccacgtgggttctcatcactgacaacacaaacatgcgaactgtttgtctatcagttttcgcgatcacacccataatgtgagcgggtacagtcactgacttcgtttgtagcggtccaatgatatgaggcatattacggtggtatgttaaccgcctagcgtagagtggcccaatatgcatgatggatgtgaccttcccatctcacagagatatcaattgcgaatcaggatgcaaatcaaggggtgttccgttcccacttagctccgagtttcctttttcaattatcgtattgaaagaatttctatatcatgcctgttgcaacagaacgggaaagattgcgctatctcgtttccccagccatggcggggatataacatatccgtgattccgtgtcccttcgccccttcgctcaccatttcccctcatgctaactcagctttgtcttggcaaaatgagaatccagatcatttgctcacaacttcttctggtggtgtcggctgttgcagcgccaactcctagggccacttttgcgctggtgccgctcgaagatccccagaactgggttgcgggtaacagcttgttcccaagcaacatcatcgcaggatatcacgctgattatgatgcctatgactccgagtcgtggtcaaattacgtgctcgagaaatgcgaggcctttgcccagtgcacatcatccgagacgttctcaggtatgtcaacccaaaagcgtgcaggagaacaccgagctaactcagggcttgtcctgctactttagggatcaattccggtacaccaaagattaggtactggtttggttacgtgtaccgaggcggcgcaacaacacaggccaactacgaaagagcagatggcgtagaggactccattgcctatacaatcgtatagtgaaagatgaaacttgcgtgcctttgttgggatttccatgctaccgttcattgagcgtcttttttatgtagcagctcgcatttccgaagaaagcacaatatataaaagaatacgggagagagtttgagttaggaagcttaacagcaatggaagctaccagagtccgataaataaagaacaaacactgaaacctagttaacaggaccatagatgaagcaaatacaagttgctctctccgaactcttccaagcaataataaagtcgcagaatccagtagatagtgacagctaataatccacagtaaattcctttttccttctttctttcttatgcgacaagaataaaaagtctgacctgctgtcactgtagctctccgatgtacggtgcatatgggcaatgctgccaaagaggggaaacgtcactcggcctatctttccttgattggattaatgatggtcttccatcccgtgtgttgcatatcggaccatatcaccctcaacgtgatttcaatggcgtggcgagcatcatgtatccatcgctccatgaaaaccacgttgcaccagccagaggatttggtcagtcgtttgtcgagctcagcctactggcgatgcatcaacaacacagccggagagttataccaccagcccctgttgctggcaatcatgctgtccgtcatcttagaatcaaatagccattcaaggtgtcggatactcgaagtatccgcttaccaactcagcctgcatgtatcccacctcatcgagatgttggagcgaaattcgagacgcctatcaaatcccacgctcgctccatccggataatcgcgcaatcagccatctcagaaacgcactgtcctgtagcagggtgccggatgtccgaagtatccgctgtgttcatgttgttatggagccccggttttggttgacaaacccgagatgacagggataacaagagttcacctacattcgatgcataaatacctggttgctgaccgactctccgtccgagggtatgatgtcgttctcctaggcttaaaaaattcagttgctccttgctcaatcaatccactttgccaagtacaatggcagcagaaaatgatttcaaagtcatcatcgtaggcgggggcatcgctggtctcactctcgccaacatgttggaaaagtttaacattgattatgtcgttttagaggctcacaaagatattgcgccccaggttggtgcgagcataggcatgtttcccaatggtctgcgaatccttgaccagatcggcatccacgatcagatcaaagctatattcaagagcgacatcccttacaacaaatcgcatatgagaaataatgaggggaaaatcatcacaaccatccatggaatcaatgatcagcttgagcgcaggtgagttccaggaggcaatgtcttcacagtgacgagactaacggtttaaatacaccaatggatttaggcatggatatggtttgctgttctttgatcgacaggcccttctacaaattctctatgatcatctccaggacaaatccaagatattaaaagggaggaaatttgagtcagctgagctcgacgactggggcgttactgcaacgtgtgcggatggttctactttccgcggtacccttcttgttggtgcagatggcattcacagcaaggctcggaccgtcatgagggctttggggggtaaattaaatccgggagccttcgacgaaaatgaggaaagcaaggtgccatgttactacagatgtagtttcggcatcgcggtagacgtgcccgggtgggttaccggcgagcagcatattgtgacaggcgatggaaggtcacagcttgttatttcggggccggacaatcgtgtgtactggttcatgtttgagaggttgcccgaggtccgatatggagatgagatcccgcgatacacgacaaaagacgaggaagagtttgcaaatcggaacgcagacgtagctattaccgaaagtattacttttggccaggtcttcgcatgtcgtctgtcttcagccctcacgccactacacgaagttgtttacaagaaatggttctttaggaggatgatcactctaggcgactctgctcacaaggtaaatacaatctctcatccgtttttgattcctttttaataacagtttccaagcccaatccaattggtggccagggaggcaatggagcgattgaatcatgcgccgaacttgtgaacatgctgctggaaaagaaagcagcccgcggtggtaccttagacaaaatgacaaccaaggagctggaagaggtcttggagcaaacacagacatcaaggcacgcgagagccaagaagattgtgcatgctgcgcacaggcatcagagaatcaacgcgtatgagaatccgttaatctctaccatcattacagggtacattttccccttggctgggcctgaacaaatccttacgaggatgtcctggaatctcataggcgctacacatctcaagaaccttccgattcccaagcgcgctcgcatgattccatacaatgacgagcttcccgcgttgccgttcagcaacataatatccatcgtcgttcgtggcggacaaatcgcctcgatggcaacattagtcttcattagtttgaaggcgttccgctttcatataccagagataaccaaatgggcccgggaagcaccaattgttattagatggttcggtgaaggccaactcactgaggtcttcaacatattcgtctccgtgtttgcaatcccactctcagatcaagatcctgggatcaggttacagcttgtcaactttctctttcagttgatatcacctctcctcatttacactatcgaagccaacagggttggtaaccaaggaactggtttgatgttcgatcttttatttgccttggggatgcagcttcgggggatcggtcagataggccctcttcatgctgctctgcatgccgtgagctctcatgaactcccaacaggacgccatattcctgtcgagactgcgaaagctctggttcctgctatcacattgggatttgtcattcctacagtacttttgtttgcacgaactccgaatacagtggcatggcaacactctctagctctctggcagtttgcgccaccaatgtttgttcttctcactcgattgatctcttccacgatcaagaaataccaccaagcaaaacttcaggggaaggaagacagaaatgacatggagcgatatgcggataaggacttgccgattcttaactccgtctacacttacgcggttgcgactcaggctaccgtccatgttgcatcgatggcatacgcgtggtcacatccgaatatatcgctgttcaaatcattccttcaagtgccgaacccgttcatctcggactggaatcttccaagtctgggcgctaacttgggtaccttcttcaaatatgacatgctgctattcactgcctcatcattggccactagcctctacagcatttgggatctgcgccgactgggttatgttacaactgccgatgctttgactgcctttgctggaacagttgcgggacaatttctggttggtccaggggcagcttgggctggattatggtactggcgggagactcgactggcaagtttgatggctagacgtcagtaagggaaactatccccaacaatatatacgtaaacattcattggagagagagaaaggagcgcccactactaaaggggccttaacccgggtctttgccaccacgggctagttctaatctaagtcaaagaaacccagtgttaaaaacgcgtcgagaatattcaacacgactataaagagctttgtttccagcgaaacacattgcccaaagagcgaaagaaaattcatggtggtagaaaagatcggcatttctctcgtcgctcgcggactgaaaaattgtccgactaccgttgagacaaaaacaactaagtctgcggtcagatttatgcacacttaataatcaatactcttcttttccgatatctccgctcctgtatgtgttctgagatcgcgagagcgctgggactctagttggatatctctgcgaatagaacatatgaatatcgtacgccaacatgaaaatcacccatactcgcccaaatggccttttaattatatgcgcaatctagtgtttgaggagtgtcttctcaagttcagaattcatgtttcaatcgcgattcgtggaaactgagggctcgtcacttcggactttgatgaaactccgaccccccacgcaattagaagtcgccgagaagcgggatgataacttctctagaagtcaaaataatatatattgcgcttattcgtatgttgaactattattcacctccttcttttatacattcaaactgacatcatcatgagtcccaccgcgagtatctccaacgatttcggcgtgcttccgatcgtttcgggagtggtatgttaaagatctctggcttaaacattttcagagagacattgtgttgattgatattaatgtcttaggccctcttcgcactctttgggtacctcatttatcttgccttttttcatccattggccaaggttcccggtccaaagctatatgccatttcaattattccttacatgtaccatctgaaatccggaaagtggcatcgtgtgctgaaagatcttcatgaccagtatggtccagtggtgcgcatcgcgccaggcgacgtgtctttcatcaacggtgacgcctggaaaattatctacggtcataagaatgggactgtcggcaattttcacaaagacacgaggttcttcccacgccgtataccaggaaagcccaatatcctcactgcggacgaatctgaccacaaaaggatccgtcgacacctatctcatgcattttcagagaaggcattgcgggggcaagagtcaatcatgcaagagtacgtgaacctcctaatacggaagctgagtgatgaagtagaaagaggagctgcggttgatatggtgaagtggtacaactttaccaccttcgatctgattggcgacttggcattcggagagccatttgggagtctcgaaagcggtggctaccatccttgggtggcaatgatttttgacattgtcaagatgacctcgcgtctctacatcctgaagcgtatcccgggtcttatctcactcacgcctctgttcataccttggaagctcctcaaggatgctcaacaccattacgagctgtgcgaaaggacggctgcaaaacggattgaaacgggaaatactgatagggaggacttcatgtcgtatatgcttcgacacaacgatgaaaagggaattagtacccctgagatcttggagacgtccaaggccgtgattctggccggcagtgagacaacggcgaccttgctctctggctgcacataccagatgctttccaaccgccatgtatatgagagacttgtcaaagagattcgatcaacattcaactcaccagaggaaattaccatgtcgtctgttgccaatctagaatacacagctgctgttctaaacgaaagccttcgaatctgtaagctgggaacatctcatcttccgcaatcgatatacattacttacagtggaatccagaccctcctgtcccaggtggcatgggtcgctttgttcccgaggaaggtactattatcgttg
